United States Patent 10,233,495 (METHODS AND COMPOSITIONS FOR SCREENING AND TREATING DEVELOPMENTAL DISORDERS) - sequence listing, part 151

SEQ ID NO: 789 - DNA, 3549327 bp, Homo sapiens (residues 2,366,219-3,549,327 of 3,549,327)
  misc_feature (215046)..(3215045): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcacacatcacaaagcaatttctcagaatgcttctttctagttttattggaagattattcctttttcaccttaggtctcaatgcgctcccaaatatcccttcagggattctgccataacggtgtttccagattgctgaatgaacagtaagttttatttctgtgaggtgaatgcacacatcacatagctgttactcagatagtttctttcgaatttttatcctgggatactggctttttgccattggcctcaaaggtctcccaaaaattccttcacagattctacaacaacagtgttttcaaattgctgaatccacagaatggtttaaatctgtgaggtgaatggatacatcccaaggaagtttctcagaaagcttctttgtagtttttttctgaagatactccctttttcaccttaagcctcaaagcactcccaaatatcactttgaaaattctatgaaaacagtgtttccaaactgctcaatgaaaagaaaggtttatctctgtgagatgaatgcacacatgacaaagaagtttctcagaaggcttctttcttgtttttatctgatgatatttcctttttcatcgtaggcctcaatgcactcccaaatatcccttcacggtttctgtcaaaagagtgtttccaaactgctgaatgaaaaggaaggtttatctctgcaaggtgaatgcacccatcacaaggtgctttctcagagagcttccttctcgtttttatcttgggatattcacttttttgccattagcctcaatgagatcccaagtgtcccttcacagattctacaatgacagtgtttttccaactgctgaaaccaaagaaaggttgatctctatgagatgaatgcacacatcacaaagcagtttctcagaaggcttctttctagtttttatcagaagatatttccttttccgccataggtcccaatgtgctcccaaatatcccttcagggattccgccataacagtgtttccagattgctgaatgaaaagtaagtgttacttctgtgaggtgaatgcacacatcacatagctgttactcagcttctttcgaatttttatcctaggatacactcttttctgtcataggcctcaaagggctcccaaatattccttcacagatactacaacaacagtgttttcaaattgctgattctgcagaatggtttaactctgtgaggtgaatggacacatcccagagaagtttctcagaaagactctttctagtttttttttttctgaagatacatcctttttcaccatattcctcaaagcactcccaaatatcacttcgcagattagaaaaaaacagtgtttccaaactgctcaatgaaaagaaaggtttaactctgcaaaatgaatgcacacatcacaaaccagtttctcaaagagctttcttctagtttttgtcctgtgatattccctccttcaccactgacctcaatgagctccagcatatcccttcacagattccacaacaacagtgtttccaaaatgctgaacccaaagaaagatttaactccttgagacggatgcacatatcacaaagctgtttctcagaaagcttcattatagtttttatctgaagatatttcctttttcaacataggccccaatgtgctcccaagtatccctttggggattctgccagaacagtgtttccagattgctgaatgaaaagtaagttttacttctgcaaggtgaatgcatacatcacaaagctgttcctcagatagcttccttctagtttttatccaggaatattcacttttatgccactggcctaaatgagctctcaaatatcccttcaccgattcgacaacaacagtatttccaaacttctgaatcaaaataaaggtttaattctgtgagatgaatgcacacatcacaaagcggtttcccagaatgcttctttctactttttatctgaagatgtttccttttttaccatcagcctcaatgcgctcccaaatatctcttcgtggattctgccaaaacagtgtttccagacataagtgtgaaaagaaagttttacctctgcaaggtgaatgcacacatcacaaagagatttctcagatagcttctttctagtttttatcctgggatatttgctttttcgcctttggcctcaatgagctccaaaatgtccattcacagaatggacaaaaacagtgtttccaaactgttgattccacagaaagtgttatttctatgagaagaatgcatacatcacaaagatgtttctaaaatagcttccttcttattttttatcctgggaaatttgcttttttgccattgacatcaatgagctcccaaatgtccatttgcagaaagtacaaaaaacagtgtttgcaaactgttgaatccacagaatggtttaactctgtgagatgaatgtacacatgagaaagcagtttctcagaaagcttctttctagtttttgtctgaagatatttccttttacaccataggcctcattgcacaccaaaatatcccttcagggattctgccagaacagtgtttccagattactgaatgaaaagcaagttttactctgtgagtggaatgcacacatcacaaagttgtttctcagagggcttccttctagtttttgtccttggatactgactttttggtcattggtctcaaagagctcccaaatattcctttgtggattctgcaacaacagtgttttccaactgctgaatccactgatggtttaactctgtgaggtgaatgcacacgtcacaaagcagtttctcagaaagcttcttttagttttttctgaagatattttctttttcaccataggcttcaaagctctaccatatatcacttggcagattctaggaaaacagtgtttgcaaactgctgaatgaaaagaaacattcaattttgcaagatgaatacacacatcacagagcagtttctcaaataccttcattctagtttttatgttgggatattcacttgttcacaattgacctcaaagagatcccaaatatccttttgcagattctacaacaacagtgtttccaaactgctgaatccaaagaaatgtttcactctatgaaatgaatgcacacgccagaaagaagtttttcagaaagattctttctcgtttttatctgaagacatttcctttttcaccataggcttcaatgtgttcctttatatccctatgcagatactatgaaaacaatgtttccagactgctgtgttaaaagaaaagtttaactctgcgagatgaatgcacacatcacaaagccgtttctcacatagattccttctagtttttaaactgagatatgtgcctttttgccattcacctcaaagagctcccaaatgtccatctgcagattctataacaacagtgtttccaaattgctgaatcaaaaaacagatttaactctgtgagatgagtgcacacatcacaaagctgtttctcagaatgcttctttctagtttttatctgaagatatttcctttttcaccataggcctcaatgcactcccaagtatcccttcacagtttctgccaaaacagtgtttcctgactgctgttgaaaaagaatattttaactctgcagggtgaacgcacacatcacagagcagtttctcaaatagcttcattctagtttttatcctggacattctctttttcaccatcggtcccgatgagctcccaaatgttcattcacaaaatggaaaaaaacagcgtttgcaaactgctgaatccagagaaatgtttaactctgtgagataaatgcacacatcacaaagcagtttctcagaaagattctttctaattttcatctgagcatatttcctttttcaccttaggcatctatgctctcccaaatatcactttgcagattctgccaatgcagtgtttccagactgctgttgggaaagaatgttttaactctttgaggtgaatgcacacatcacaaagcagttactcagatatcttcttactagtttttatcctgggatattctgtttttcaccattggcctcaataatatcccatatatccattcacaggttctacaacagtgtttgcaaactgctgaatccacagaaagttgtaaatctgtgatatgaatgcaaagatcacaaagcagtttcctcaaaagcttctttctagtgtttatctgaagatatttccttttgttttttttttctttttggagatggagtctcactctgacacccaggctggagtgcaggggatgatctcggctctatgcaagctctgcctccccagttcatgccattcttttgcctcagcctgacatgtagctgggactgcaagtgcctgccaccatgcctggataattttttctgtttttagtagagatggggtttcactttgttagccaggatggtcttgatatcctgacctcgtgaccctcctgccttggtctccaaaagagctgggattacaggtgtgagccaccacagccagactccttcttcaccatacatctcaatgcactcccagatatccctttgcagatactaagaaaacactgttcccaaattgctgaatgaaaagaaagattaaactctgttagatgaatgcacacaccaaaaagctgtttctcatatagtttccttatagtttttatcctggaatattcactttttgcctttggtctcaatgagctctgtaatatccctttgcatattctacaacaacactattttcaaattgctgattccaaagaaaggtttaactctgtgaaatgaatgcacacatcataaagcagtttctcagagagcttccttatggtttttatctgaagatatttcctttttcaccataggtctcaatgtgctcaaaatatccctttgctgctactgtcaagacagtgtttccagacttctgtatgaatagaacctttttaacattatgaggtgaatgcacacatcacaaagcatttattcagatagctcctttctagtttttatcctgggatattccctttcttgtgattggccttaataagctcccaaaggtccatttgcagattctacaagagtggttgccaactactgaatccacagaaaggtttaaatctgtgatatgaatgcacagataacaatgcagtttctcagaaagtttctttctagttttcctcagaagatatatcatttttcaccataggtctcaatgcgttcctaaatatgtcttcatggataccgccaaaacactgtttccagactgctgaatgaaaagaaggttttcactctgtgagaagaatgcacacatcaaaatcaattgtccatatagcttccttctagttttgatcctgggatattcaatttttcaccattggcctcattgagctctcaaatgtccaatcgcagaagggataaaaactgtttgcaagctgctgaagccacagaaatatttatctctgtgaggtgaatgcatatatcacaagcagtttctcagaaaacttctttctagttttcatctgaagatatttcctttttcaccataagcctcaatgtgctcccagatatcccttcatagacactatgaaaacagtgtttccaaactgctgaatgaaaagaaaggtttaactctgtgagatgaatgcacatatcacaaagcagtttatcaaatagcttccttctagtttttatcctgggagattcactttttcgccattgacctcaaagagctcccaaatgtcaattcacagaatggacaaaaacagtgtttgcaaactatgaaatacacagaaaggttgaattctgtgagatgaatgcacacatcacaaagcagtttatcagaaagcttctttctagttttcttctgaaggtatttcctttttcaccgtaggcctcattacactaacagatatcacttcgcagatactcagaaaacagggtttacaaactgctaattgaaaagaaaggtttaattttgttaggtgaatgaacacatcatgaagcaatttctcaaataccttcattctagtttttatattgggatattcactttttcgccattgacctcaaagagttcctaaatatcctttaacaaattctacaacaacattgtttccaaactgccgaatcaaaagaaatgtttcactctgtgaaatgaatgtacacatcagaaagcagtttctcagaaagtttctttctagtttttatctgaagatacttcctttttcaccattggcctcaaatcgctcccaaatataactgtgcatattttagaaaaacagtgtttccaaactgctgaatgaaaagaaggcctaactctgagagatgaatgcacccatcaaaaagcagtttatcagagagcttccttctagttttttttcttgggatattcactttctatactttggcctcattaagcacccaattattccttcactgatctgcaaccacagtgtttccaaactgctgaatacaaagatagttttagctctgtgagatgaatgcacacatcaccaagcagtttctcagaaagcttctttctatttttcatctgaaggtatttcctttttcaccataggcctcaatgtgctcccaaatatctctttgcagattctgccaaaacagtgtttccagactgctgaatgaaaagaaatatttaactctgtgagttgaatgcacacatcacaaagcagtttctcagatagcttccttctagtttttctcctgggatgttcacttttttgccattagcataaatgagctcccaaatatcccttctcatattctacaacaacagtgcttccaaacagctgaatccaaagaatggtttaactctgtgagatgaatgcacacatcgcaaagcactttgtcagaaagttactttctagtttttatctgaagatattcccattttcaccataggcctctatgtgctcccagatatcagttctcagattctacaaaaacagtgtttccaaatggctgaatgaaaagcatgttttaactctgtgagatgaatgcacacatcacaaagctgtttctcagattgtttccttctactttttttcctcgggtgtttccttttttgccattcaccttaatgagctcccaaatatcaattcgcagattctaaaactacaggggttccaaactgctgaatccacagaaaggtttaaccctgtgagatgaatacacgcatcacaaagcagtttctcagaaaccttctttctaatttttacatgaagatatttccttttaaaccataggcttcaatgagctcccaaatatcctttcacagaatggaaaaaaacagtgttgcaaacgactgaatccacagaaaggtttagctctatgagatgaatgcacacatcacaaagcagtttttcagaaatcttctttctagtttttatctgaagatatttcctttttcaccataggccactatgcgctctgagatatccctttgcagattctataaaaacagtgtttccaaactgctgaatgaaaagaaagttttactctatgagatgaatgcacacatcacaatgtaatttctcagtaagtgtatttctagttttatctgaagatatttcctttttcaccatagtcctgaatgaactccaaacattcctttgcatattctaccaaaacagtttttccagactgctgaatgaaaagaaagttttaactctgtgaggtaaatgcacacatcacaaagtggtttgtcagatagctttcttctagtatttatcctgggatattttctttttcaccagtgacctaaatgagctcccaaacatcctttcgcagattctacaacaacactgtttccaaactgctgatttcaaagaaatgtttaaatctatgagatgaatgcacacctcaaaaagcagtttctcagaaagcttcattctagtttttatctgaaatttttttttcaacaaaggcatgtatgcgctcccaattttctcctcacgtatcctgtcaaaacagtgtttccagactgctgaatgaaaagaaaagtttatctcttcaaggtgaatgcacacatcacaaagaagttttttagaaagcttctttctagtttttatctgaggatattacctttttcaacataggccttaaaccactcccaaatatcccatcatggattctgccaaaatagtgtttctagcctgtcagatgaaaataagattttaactcttcgagacgaatgcacacatcacaaagcagtttctcagatagcttccttctagcttgtatcctaggatattcactctatcgtcattggcttctatgagctcccaactgtccatttgcagaatggacaataatgttttcaatgcactgtatcaaaagaaaggtctaactctgttagattaatgcacacaactcaaagaagtttttcaataaacttctttctattttttatctgaagatttttcctttttcatcataggcctcaaagcactcccaaatatcacttcacagattctatgaaaatagtgtttccaaactgctgaatgaaagaaaagatttatctctgagagatgaatgcacacatcacaaaacgggttctcagatagcttccttctagttttttcctgggatattcaatttctcacatttggactcattaagctcccaaattcccctttgcagatcctacaacaacagagtttccaaactgctgaatctaaagaaaggtttaactctctgagatgaatgcacacatcacaaagcagtttctcagaaagcttctgtctaatttttatctgatatttccttttttcatcatagacctcaatgcactcccaaatatcccttcacagattctgccaaaacattttttccagactgctgaatgaaaagaaaattttaactctgtgaagcagatgctcatgtcacaaagcagtttcccagatagatttcttctcaaatttttcctggtatatattttttctcacttttggcctcattaagctcccaaatatcccttcacagattctacaacaacagtgtttccaaactgctgataccaaagaaaggtttaactctgtgagatatgaatgcacacatcacaaagcagtttctcaaaagcttctttctagatttatgtgaagatatttcctttttcaacataggcctcgatgcactccaaaatatccctttgcggatgttgtcaaaactctgtttccagactgcagaattaaaagaagattttaactctgtgaagtgaatgcagacatcacaaagctgtttctcagattgcttccttctagtttttatcctggaattttcacatttttgccattggtcctagtgagctcataaatgtccatatgcagaatggacgaaaacagtgcttgcaaactgctgaatccacagaaagttttaactctgtcagatgaatacacacatcacaaagcagtttctcagaaagcttctatctagtttttatctgaagatattgtctttttcaccataggcttcaaatacgctcccagatatcccttcatagatactataagagcagtgtttccaaactgctgaatgaaaagaaaggtttaactctgtgagatgaatgcacacatcacaagctgggttctcagctagcttccttctactttttatcctgggacaatcactttttcaccaatggcctaaataaactcccaaatatccattcgcagaatgcacaacaacagtgttttcaatctgctgtatccaaaaaaaggtttaactctatgagatgaacgcacacatctcaaagcagtttctcagaaagcttttttctagttttaatctgagatatttcctttttcatcataggcctcaatgggctcaaagttatcaccttgcacattctatgaaattagagtttccaaactgctgaatgaaaagaaaggattagctctgagaaatgcatgcacacatcacaaagtggtttcttagatagcttccttctagtatttatccttggatatttgcttttttgctattggccacaatgagctcccaaatatcccttcgcagattctacaacaacagagtttccaaactgctgaatccataaaaaggcttagctctgtgggatgaatgcacacaatacacagcagtttctcagatagcttccttccagttgtcacctgggatatttgatttttcgatattggactcaatgagctcccaaatgtccatttgcagaatggacaaaaacagtgtttgcaaatggctgaatccacagaatggtttaactttgtgaaatgaattcacacatcatgaaggagtttctcagaaaacttctttctagtctttatctgaagatatttcctttttcaccttagacctcaatactttctctgatatctccttatagattctatgaaaacaatgtttccaaactgctgaattaaaagaaagatttaactctgtgagaggaatgcacacatcacaaagccgtttctcagatatgttccttctactttttttcctgggatattcactttttttgccattggcttcaatgagctcctaaatatcccttcacagattctacaacaacagtgtttccaaaccgctgaaaccaaataagtgttttactctgagaaatgaatgcacacaacagaaagcagtttctcagaaagcttctttctagtttttatctgtagatattatttcctttttcaccataggcttcaatgcactcccaaatataactgtgcagtttctgcaaaaacagtgtttccaaactgctgaatgaaaagaaaggtttaactctgggagatgaatgcacccatcacaaagtggtttcccagatagcttacttctagtgtttttgctggaatgttccctttcttgcctttggcctcattatgcaccaaagtatccctttgcaggatctgcaacaacagtgtatccaaattgctgaatccaaaggaaggtttaactctgtgagatgaatgcacacctcacaaagcagtctctcagaagcttttttctagtttttatctgaaggtatttcctttttcaccatgggtctcaatgtgctcccaaatatccctttgtggattctgccaaaacagtgtttccagagtgcagaatgaaaacaaaattctaactctgtgagttgaatgcacacatcaccaagcagtttctcagatagcttccttctagtttttatcctgggatgtttcctttttcaccactggcctcagtgagctcccaaatatcccttcacagattctaaaactacagtgattccaaaatgctgaatccaaaaaaaggtttaactctgtgagatgaatgcagacatcagaaagcaatttatcagaaatcttctttctaatttttatgtgaatatatttcctttttcaccataggcctcaatgaactcccaagcttcccttcacagatggacaaaaacagtgtttgcaaatggctgaatccacagaaaggtttaacactgtgaggtgaatgcacacatcacaaagtagtttctcagaagctttctttctagtttttatctgaagatatcttctttttcaccacaagcctcaatgtgctcctaaatatcccttcgtggatttgccaaaacagtgtttacagacgactgaatgaaaagaagattttaaccctgcgagatgaatgcatacatcacaaagaggtttatcagatagcttccttctggtttttatcctgggatatttgcttttttgccattggcctcaaagagctcgcgaatgtccattctcagaatggacaaaaacagtgtttgcaaactgctgaatccacagaaagttttaactctttgaggtgaatgtgtatatcacaaagcagtgtctcacaaagattctttctagtttttagctcaaggtacttgctttttcactatagacctcaatgctatcctagatgttaccgtgcagattctatgaaaacagtgtttccaaactgctgaatgaaaagaaaggtttaattctgtgagatgaatgcacacagcacaaactggtttctcagattgcttccttctagtttttatcctgggatatttgctttttcaccattggcctcaatgagctccaaaatgtccatttgcagaatggacaaaaacagtgtttgcaaatggctggattcacagaaaattttatctctgtcaggtgaatgcacacatcccagagcagtttcttagaaaacttctttctattttttatctgaagatatttcctttcccaccataggactcaatgcactctcagatatcccttggtagattctacaaaaacagtgtttccaaactgctgatggaaaagaaaagtttaactctgtgggattaatgcagacttctcaaagtggcatctcaaatagcttccttctaatttttatccttgatgttctctttttcaccatcggtctcaatgagctcccacacatcccttcacagattctgcaacaacagtgtttcaaaactgctgatccaaagaaagatttaactatgtgaggtgaatgcacatgtctcaaagaagtttctcagaaagcttctttctagtttttatttgaagatatttcatttttcatcatgggcctcaatgcgctccaagatatcactttgcagattctatgaaaacagtgtttccaaacagctgaatgaaaagaatggtttatctgtgagagatgaatgaacgcatcacaaagcactttctcagagagcttccttctagattttttcctgggatattcactttctcatatgctacaacagcagatgctacaacaacagtggttccaaactgctgaatccaaagaaagtcttaactctgtgagatgaatgcatacatcacaaagcagtttttcagaaagctcctttctagtttttacctgaagatatttcctttttcaccaaaggccacaatgtgttccaagatgtccttttgcagattctacaaaaacagtgtttccaaacggctggcatcacaaagccggttctcagattgcatccctctagtttttattctggaatattcactttttcaccattggcctcaatgagctcccaaatgtccattcgcagaatggacaaaaacagtgcttgcaaacagctgaatcctcagaaaggtttaactttgtcacatgaacgtacacatcaaaaataagtttctcaaaagcttctttctagtttttatctgaagatatttcttttttcaccataggcctcaatgcattcccttataacacttaacagattctatgaaaaaactctttccaaactcctgaacgaaaagaaaattttaaatcgtgagatgaatgcacacgtcacaaagcagtttctcagaaagctcctttctggtttttatctgaagatacttcttttttaaacataggcctcaatgagctcccaaatatcccttcacagattctacaacaacagtttccaaactgctgattccaaagaaaggtttaactctgtgagattaatgcacacatcacaaagcagtttctcagataacttccttctagtttttattctgggatattttcttttttgccattggctttgatgagctcccaaatgtccagtggcagaatagtcaaaaacagtgttttaagctgctgaatacacagaaatatttaactctgtgggatgaatgcacacatctcaaagcagtctctcagaaagcttctttctagtttttatcagaagatattccctttttcaccatggacctcaatgagctctgtgttatcccttcgcagattctatgaaaacagtgtttccaaactggtgaatgcaaagaaagttttaactctgtgagatacatgcacacatcacaaaccattttctcagattgcatccttccagtttttttcctgggtaatttgctttttggctgtttgtcttaatgagctcccaaatatcccttcacagattctgaaacaaaagtgtttccaaactgctgaatctaaagaaaggtttaaatctgtgcaatgaatgcacacatcacaaagcagtttctcaaaatcttctttctagatttattggaagatatttcctttttcacctttggcctcaatgtgctcccagatatcacttcacaggttttatgaaaacaccgttcccaaagtcccgaaagaaaagaaagatttaaatctgcaagatgagtgcacatatcacaaagcagtttctcagaaagcttgtttctacttttatctgaagatatttccttttttaaacagaagcctcaatgagctccaaaatgtccctttgtggattctgccaaaacaggttttccaaactgctgaataaaaataaagttttaaatctgcgagatgaatgcacataacaaagtggtttgtcagatagatttcttccagtttttttcctgggatattcaatttttcaccatttacctcaatgagctcccaaatatcctttctcagattctgggacaacaacgtttccaaactgaggaattcaaaggaaggtttaactctataagatgaatgcacacatcaaaaagcagtttctcaaaatcttctgtctagatttatctgaagatatttcctttttcacaataggcctcaatgcgctaccagatatccattcttatattctgccaaaaaagttttctcagactgctgaatgaaaagagaggtttaactctgctagatgaatgcatgcatcacaaagtggtttctcagattgcttccttctagtttttatcctgggatattcgctttctcaccattagcctcaatgagctcccaagtgtccttttgcagaatggacaaacacagtgtttgcaaacagctgaatccacagaaatttttaactctgtgcgatgaatgcacacatcacaaagcagttttttggaaagcttctttcgagtttttattggaaaatatttccttacataggcctcagtgtgctcccagatatcccttcacagattctaggaaaccagtgttttcaaactgcttaatgaaaagtaaggtttaaccctgtgagatgaatgcacacatcacaaagctgtttctcagatagcttccttctaatttttatcctgggatattctcttttttgccatcgacctcaatgagctcccaaatattccttcacagattctatgacaacagagtttccaaactgatgaatccaaagaaagttttaactctgtgagacgaatgcacacatcactaaagcagtttctcagatagcttccttctagtttttattctgggatattctctttttcgctattggctttaatgagctctcaaatgtccagtcacagatggtcaaaaacagtgtttccaaacttctgaatccacagaaatgtttaactctgtgagatgaatgcacacatcacaaagcagtctctcagaaagcttctttctagtttttatctgaagatatttcctttttcactataggcctcaatgagttctgaattaaccctttgcagattgtacaaaaacagtgttaccaaactgctgaatgcaaagaaaaatttaactctgtgagataaatgcacataacagaaatcgttttctcagaatgcttccctctagttttttcctgggaaattggctttttcaccattcaccttaatgagctcccaaatatcccttcacaagttctaaaacaagagtttttccaaactgctgaatccaaagaaagtttaactctgggtgatgaatgcacacatcacaaagcagtttcttagaaagcttctttctaatttttatatgaatgtatttccttttttaccaaaggccccaatgtgctcccaaatatccctttacagaatggaaaaaaaccgtgtatgcaaacggctgaatcctcccaattgtttaactctgtgaggtgaatgctcacctcacaaagcagttactatgaaaatattcactttttctccatgggcctcagtgagctccctgatataccgtcaaagattctacaacgacagtgtttccaactgtcaaatccaaagaaatgtttaactctgtgagatgaatgcacatatcacaaagcagtttcccaggaagcttctttctagtgtttatctgaagatatttcctttttcaccataggcctctatgcaatcataaatatcactacttggcatatcgtgtcaaaacagggtttccagactactgaatgaaaagaaggttttaaggttgctaggtgatttcacaaatcaaaaagcggtttctcagatagcttaattccaatattgataatgggatattcgcttattcgtcattggcctcaatgagctcctaaatgtccatttgcagaatggacaaaaacagtgtttctagactgctgaatgaaaataaaggtttttctctgcaaagtgaatgcacatatcacaaagaggtttctcagatagcttccttccagtttttataaagggatatttgcttttttcctttggcctcaatgagttcccagatacccctttgcagattctacaacagtgtttctaaactgcttaatgaaaaaaaagttttaactctgtgagatgaatgcacacatcacaaagcagtttctcagattacttccctctggttttattccttgggtattcacttttttgacatttgctttaatcagttctcaaatatcccttcagagatcctaaaacaacagtgtttccaaacagcccagtgaaaagaaagatttaactctgtgagatgaatgcacacatcacaaagcagtttctcagaaaatttctttctaatttttatgtgaagatattccctttttcaccataggcctcaatgcactccctaatatgcctttgcagaatggacaaaaacagtgttagcaaatggctgaatccacagaaaggattaaccctgtgagatgaatgcacacatcacaaagcggattctcagagagcttctttctagtttttatctgaagatatttcctttttcaccatgggcctcaatgtgatcccagatatcactttgcagattctacgaaagcagtgtttccaaactgctgattgaacagaaaggtttaactctgtgagatgaatgcatgcataactaagcagtttctcagaaagcatctttctattttgtatctaaatatattttctttttctcataggcctcaatgcactcccatatatcccatggaggattttacaaaaacagtgtttccagactgctgaatgaaaagaaaggttatctctgcgaggtgaattcacacatcacaaagaggtttctaagatagtttcctttcagtttttatgcatggatgttcacttttttgcctctggtctccatgagcaccaaattgtccattggcctaatggacaaaaacagtgtttgcaaactgctgaatccaaataaagttttaactctgtgagatgaatgctgatatcccagagcagactctcagaaagcttctttctagtttttatctgaagagatttccttttcaccataggcctaaatgcactcccaaatatcacttcgcagatatttgaaaacagtgttttgaaactgctgaatgaaatgaaaggtttaattctgccagatgaatgcacacatcacaaagtggtttcacaaagagcttccttctagtttttgtcctgggatattcactttttccattggctcaatgagctctcaaatgcacatttgcagaatggataaaaacagtgtttacaaaatgctgaatccacagaaagttttaactctgtgagatgaatgcatacatcacagggtagtttctctgaaagcttctttctagattttatctgaagatatgttctttttcaccatagggctaaatgcattccaaaatatcccttttgggattctgtcaaaacagtgtttcctgatttctgaataaaagaaagctttatctctgtgaggtgaatgcaaacatcactaagtggtttctcagatagcttctttccagtttttatcctgggatatttgcgttttcatcattggcctcaatgagctcccaaatatcccttcacagattctacaataacagtgtttccaaattggtgaacccaaagaaattttgaactctgtgagatgaatgcatacatctcaaagaagtttctcagaaagcttctttctagtatttatctgaagatatttcctttttcaccataggccccaatatgctcccaaatgtccctttgcaatcactaaaaaaacagtgttttcaaactgctgaatataaatgaatgtttaactctccgagatgaatgcacacatcacaaagctgtttctcagaatgcttctatctagtttttatctgaaggtattttctctttcaccatagatctcaatacattcctaaataacgtttcctgattctacaagtgtgcttccacactgctgaatgtatagaaaagtttacatctgtgaagtgaatgctgacatcccatagcggtttctcaggtagcttccttcttgtttttatcctgggatattcacttttttgctattcacgtcaatgagctctgaaatatccatttgcagaaaggacaaaaacggtgtctccaaactgctgaatcaaaagaaaggtttaagtctgtgagatgagtgcacacatcacaaagcagtgtctcagaaactttatttctagtttttatctgaagatatttcccttttctcattaggaatcaatgtgctcccaaatactccccctcagattctacaaaaacggtgtttcaaaactggtgattgaaaggaaaggtttagctccatgagatgaatgcacacatcaccaagcagtttcccagtgtgcttccttctagtttttatgctggtatacttgctttttcaaaattggcctcaaagagctcccaaatgtccattggcagaatagacaacaacagtgttttcaaactgtagaaataaaatcaattttaactctgaaagacgaatgcacgtatcacaaagcactatttcagatatgttccccctagtttatatccagggatattcactttttctccatttgtctcaatgagctcccaaatgtccattcacataatagataaaaacagtgttttaacactattgaatcaaaagaaaggtttaactctgtgagttgagtgcacccatcacaaagcagtttccctaaaagattctttttaggtttatctgaaggtgtttcttttttcaccacaggcctcaatgcattcctaatatcccttggcagattctagaaatacagtgtttccaaaccgatgaatgtaaagaaaggttttgctctgctagatgaatgcacacatcagaaagtggtttctcaggtaggttccttctagtttttatcctgggataatcactgtttcaccattgttctcaatgagccccaaattgtccattcgcagaatggacaaaaacaggttttcaatactgctgaatccaaagaaaggtttaattctgagatacgaatgcacacaacaaaaagcagcttctcagatagcttctttctagtttttatctgaatatggttcccttttcaccataaaccttagtgcactcctaaatatcctttcacagactctacaaaaacattgtttccaaactgctgaatgaacagaaaaatttaattctgccacacgaattcacacgtcccaaagtggtttctttgttagctttcttctatttattatcctgggatatttgcctttttgcctttggcgtcaatgagctcacaattgtccatttgcagaatggtcaaaatagtgtttccaaaatgcagaatcaaaagaaagttttcattctgagagctgaatgcacacatcacaaagcagtatctcagaaggcttctttctagtttttatctgtagaaatttcctttttcacctttagcttcaatgtgctcccaaacatcccctcgcagaatctacaaaagggtgtttctaaactgctgaatcagcagaaagttttacctaagttagatgattgcagacatcacaaagaagtttctcagaaagtttctttctattttttatcagaagatactttctttttcaccatagtcctcaacattctcctaaatatgccttcacagattctacaaaaataagtttttccaaactactgaataaaaagaaaggtttaactgtggcgtgaatgcacacattacaaagtggtatctcagatagcttccttctagttttatacgggaatatttgttttttcaccattggcatcaatgagctcccaaatgttgtttggtagaatggatgaaaaccgtgtttccagagagaggagccaagatggccgaataggaacagctccggtctacagatcccagtgtgagtgatgaagaagatgggtgatttctgcatttccatctgaggtgctgagttcatctcactagggagtgctagacagtgggcacaggccagtgggtgcgtgcaccatgtgcgagctgaagcagggcgaggcattgcctcacctgggaagcacaaagggtcagggagttccctttctgagtcaaagaaaggggtgacagacggcacctggaaaatcgggtcactccccccctaatactgcacttttccgatgggcttaaaaaacggcgcaccgcgagattatatcccgcacctggctcggagggtcctatgcccacggagtcttgctgattgctagcacagcaggctgagatcaaactgcagggcggcagctagtctgggggagggccgcccaccattgcccaggcttgcttaggtaaacaaagcagctgggaagctcgaactgggtggagcccaccacagctcaaggaggcctgcctgcctctgtaggctccacctctgggggcaggacacagacaaacaaaaagacagcagtaacctctgcagacttaaatgtccctgtctgacagctttgaagagagcagtggttctcccagcatgcagctggaggtctgagaaggggcagactgcctcctcaagtaggtccctgacccctgacccccgagcagcctaactgggaggcaccccccagcaggggcacactgacacctcaaacggcagggtactccaacagacctgcagctgaaggtcctctctgttagaaggaaaactaacaaacagaaaggacatccacaccaaaaacccatctgtacatcaccatcatcaaagaccaaaagtagataaaaccacaaagatggggaaaaaacaaaacagaaaaactggaaactctaaaaagcagagtgcctctcctcctccaaaggaacgcagttcctcaccagcaatggaacaaagctggatggagaatgactttgacgagctgagaaaagaaggcttcagacgatcaaattactctgagctacgggaggacattcaaaccaaaggtaaagaagttgaaaacttcgaaaaaaaattagaagaatgtataactagaataaccaatacacagaagtgcttaaaggagctgatggagatgaaaaccaaggctcgagaactacgtgaaggatgcagaaacctcaggagccgatgcaatcaactggaagaaagggtatcagcaatggcagatgaaatgaatgaaatgaagtgagaagggaagtctagagaaaaaagaataaaaagaaacaagcaaagcctccaagaaatatgggactatgtgaaaagacgaaatctacgtctgattggtgtacctgaaagtgatgcggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaactgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaagaacaaccggtaccagccactgcaaaatcatgccaaaatgtaaagaccatcgagactaggaagaaactgcatcaactaacgagcaaaataaccagttaacatcgtaatgacagaatcaaattcacacataacaatattaactttaaatgtaaatgggctaaatgctccaattaaaagacacagactggtaaattggataaagagtcaagacccatcagtgtgctgtattcaggaaacccatctcacgtgcagagacacacataggctcaaaataaaaggatggaggaagatctaccaagccaatggaaaacaagaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaataaaggagcaccaagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagcagagctaatagacatctacagaactctccaccccaaatcaacagaatatacatttttttagcaccacatcacacctattccaaaattgaccacatactggcaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactgctggatacataacgaaatgaaggcagaaataaagatgttctttgaaaccaatgagaacaaagacacaacataccagaatctctgggacacattcaaaacagtgtgtagagagaaatttatagcactaaatgcccacaagagaaagcaggaaagatccaaaattgacaccctaacatcacaattgaaagaacgagaaaagcaagagcaaacacattcaaacgctagcagaaggcaagaaataactaaaatcagagcagaactgaaggaaatagagacacaaaaaacccttcgaaaaattaatgaatccaggagctggttttttgaaaggatcaacaaaattgatagaccgctagcaaaactaataaagaaaaaagagagaagaatcaaatagacacaataaaaaatgataaaggggatatcaccaccgatcccacagtaatacaaactgccatcagggaatactacaaacacctctacgcaaataaactagaaaatccagaagaaatggataaattcctggacacatacactctcccaagactaaaccaggaagaagttgaatctctgaatagaccaataacaggagctgaaattgtggcaataatcaatagtttaccaatcaaaaagagtccaggaccagatggattcacagccaaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaacagaatccagcagcacatcaaaaagcttatccaccatgatcaagtgggcttcatccctgggatgcaaggctgcttcaatatatgcaaatcaataaatgtaatccagcatataaacaaagccaaagacaaaaaccacatgattatctcaatagatgcagaaaaggcctttgacaaaattcaacaacccttcatgctaaaaattctcaataaattaggtattgatgggaagtatttcaaaataataagagctatctatgacaaacccacagccaatatcatactgaatgggcaaaaactggaagcattccctttgaaaactagcacaagacagggatgccctctctcaccactcctattcaacatagtgttggaagttctggccagggcaattaggcaggagaatgaaataaagggtattcaattaggaaaagaggaagtcaaattctccctgtttgcagatgacatgattgtatatctagaaaagcccattgtctcaggccaaaatctccttaagctgataagcaacttcagctaagtctcaggatacaaaatcaatgtacaaaaatcacaagcattcttatacaccaacaacagacagagagccaaatcatgaatgaactcccattcacaattgcttcaaagagaataaaatacctaggaatccaacttacaagggatgtgaaggacctcttcaaggagaactacaaaccactgcccaaggaaataaaagaggatacaaacaaatggaagaacattccatgctcatgggtaggaagaatcaatatcgtgaaaatggccatactgcccaaggtaatttacagactcaatgtcatccccatcaagctaccaatgtctttcttcacagaattggaaaaaactactttaaagttcatatggaaccaaaaaagagcccacatcgccaagtcaaccctaagccaaaagaacaaagctggaggcatcactctacctgacttcaaactatactacaaggctacagtaaccaaaacagcatggtactggtaccaaaacagagataaagatcaatggaacagaacagagccctcagaaataacaccgcaaatctacaactatctgatctttgacaaacctaagaaaaacaagcaatggggaaagcattccttatttaataaatggtgctgggaaaactggctagccatatgtagaaagctgaaactggatcccttccttacaccttatacaaaaatcaattcaagatggattaaagacttaaacgttagaccaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaatatgggagaaaattttcacaacctactcatctgacaatgggctaatatccagaatctacaatgaactcaaacaaatttagaagaaaaaaacaaacaaccccatcaaaaagtgggcgaaggacatgaacagacacttctcaaaagaagacatttatgcagccaaaaaacacatgaaaaaatactcatcatcactggccatcagagaaatgcaaatcaaaaccacaatgagataccatctcacaccagttagaatggcaatcattaaaaatcaggaaacatcaggtgctggagaggatgtagagaaataggaacacttttacactgttggtgggactgtaaactagttcaaccattgtggaagtcagtgtggcaactcctcagggatctagaactggaaattccatttgacccagccatcccattactgggtatatacccaaaggactataaatcatgctgctataaatacacatgcacacgtatgtgtattgcggcattatacacaacagcatagacttggaaccaacccaaatgtccaacaatgatagtctggattaagaaaatgtggcacatatacaccatggaatactatgcagccataaaaactgatgagttcatgtcctgtgtagggacatggatgaaattggaaatcatcattctcagtaaactatcacaagaacaaaaaaccaaacaccgcatattctcactcataggtgggaactgaacaatgagattccatggacacaggaaggggaatatcacactctggggactgttgtggggtggtgggaggggggagggatagcatcgggagatatacctaatgctagatgacgagttagtgggtgcagtgcaccagcatggcacatgtatacatatgtaactaacctgcacaatgtgcacatgtaccctaaaacttaaaagtgtaattaaaaaaaaaagaaaaccgtgtttccaaaactgctgaatccaaagaaagtttgaactttgtcagatgaatgagcacatcacaaagcagtatctcagaagcttctttctagtttatatctgaagataatttctttttcaacataagcctcaatgcactctgaaatatcacttcacagattcttcaaaaacagtgcttccaaactgctgtatgaagagaaaggtaaagtttgcagatgagtgcacacatcataaagacatttctcagaaggttttcttctagtttttatcctggaatatttgatttttcactgttggcctcaatagctcccaaatgttcattcccggaatggacaaaaacagtgtccctactgctgaatcaaaagaaattattcactctgagagctgaatgcacacattacattgcagtttcttagacagtttcttccttgttttcatatgaaaatattatcttattcactgtaggcgtcaatgcactcccaaacatccctttgctgattctacaaaagcagtgtttccaaactgctgaatgaaaagaaaggtttacttctgtgagacgaatgcacaaatcacaaagcagtttctcagagagattccttctagtttttatcctgggatatttgctttttcatcattggcctcaatgaactcccacatgtccactggcagaatggacaaaaacagtgttttcatattgctgaaagaaaataaacgtttatgtctgtgagatgaaagcacacataacaatgtggtttctcatataagttaattctagtatttgtactgggatattcgtctttttgccttggcctcaaagagctcccaaatttccattcacagaatggacaaaatcagtgtttccaaactgctgaatcaaaagaaagttttaatattttgagatgaatgcacacattacaaagcagtttctcagaaactgtgaatatcccaggataaaagctaatttaaagctatctgtgaaactgatttgtgatgtgatcattcatcttgcagaattaaactttcttttcattcagcagtttggaaacactctttttgttgaatctgcaaagggatatttgggagcacattgttgcataaagtcaaaaagaaaatatcttcaaataaaaactagaaagaatctgagtacctgctttgtgatgtgtgcattcagctcaaagagttgaaactttcttttgattcagcaatttggatacactgtttttgtttattctgtgaagggacatttggcagctcattgaggccaatggtgaaaaattgaatatactaggataaaaactagaaggaatctatctgagaaacctgtttgtgatgtgtgcattcatctcgcatagttaaaccttctttttgattcagtactttgagaacactgtattgtccattctgcgcatggacatttggaagcccattgaggcttaatgcaaaagtgaatatccccagataaaaaagaaggaaactatctgagtaaaaacttggtgacatgtgccttcatctcatagagtgaaacctttcttttatttcagcagttttaaaactctgtttttttccattctgtgaatggacatttgggagatcattagtgcttagcattaaaaagcaaatattccacgataaaaactataaggaagccatctgaggaacagctttgtcatgtgtgcattcatctcaccgagttaaagctttctttttattcagcagtttggaaacactgtttttgtagtatctgcaaagggatatttgggagcacattgaggcctatggtcaaaaagaaaatatcttcagataaaaactagaaagaagcaaaaagggaaaatttgacttcctcttttcctaattgaatgccctttatttccttctcctgcctgactgccctggccagaacatccaacactatgttgaacaggagtggtgagagagggcatgcctggcttgttccagttttcaaagggaatgcttccaggttttgcacattcagtgtggtattggctgtgagtttgtcatagatagctcttattattttgagatacatcccatcaatacctgaattattgacagtttttagcacgaaggattgctggattttttcaaaggccttttctgtatctattgagataaccatgtggtttttgtcattggttctgtttatatgcttgattacgtttattggtttgcgtatgttgaaccagccctgcatcccaagggtgaagccccattgatcatggtggataagcttcttgatgtactgctggatttggtttgccagtattttattgaggatttttgcatcgatgttcatcaaggatattggtctaaaattctctttttttgttgtgtctctgcccagctttggtatcaggatgatgtggtctcatgaaatgagttagggaggattccctctttttctattgattggaatagtttcagaaggaatggtaccagcccctccttgtacctgtggtagaattcagctgtgaatccatctcaaagatcaacaaaaattgaaagaccattagaaagactaataaagaaaaaaagagagaacaatcaaatagatgcaataaaaatgataaaggatatatcatcaatgatcccacagaaatacaaactaccatcagagaatactataagcacctctatgaaaatgaactagaaaatctggaaaaatggataaattcctggacacatacacccttccaagactaaagcaggaagaagttgaatctctgaatagaccaataataggctctgaaattgaggcaataattaatagcttaccaaccaataaaaggaaacagggattttgtagaatctgtgaagggatatttgggagtgcattgaggtgtacggtggaaaaggaaacatcttccaaaaagaactagaaagaaactttctgagaaactgctttgtgatgtgtgcattcttctcattacaataaaattttcttttaattcagctgtttggaagcacactttttgtccgttctgcgactgggaatttgggagctcactgagggcaatggcaaaaaagtgaatatctaaggctaaaaacaagaaggaagctatctgagagaccattttgtgatgtttgctttcatctagcagaggtaaacctatcttttcatttagcagtttggaaacactctttttgtagaatatacgaagggatatttgggagcacattgaggcttacggtgaaaaaggaaacatcttcagataaaaactagaaagattctttctgtgaaactgctttgtaacgtttgcattcatctcacagagttaaacaattcttttgattcagcagtttggaaacactctttttgtaaattttgtgaatggacatttgggacctcattggggccactagcaaaagagaaaatattccaggataaaactataaggaagctattggagaatctgcgatgtgatgtgtgcattcatctcactaagccaaacctttcttttcgttcagcaatttggaaaccctatttttccacaatctgcgaaggtatatttgggagcttattgcagtctatattggaaaagaaaacatcttcatataaaaactagaaagatgcttgctgagaaacttctttgtgatgtgtgcattcatctcagaaagatatatcttctttggattcagcagtttggaaacactgtttttgtccattctgcgaatggacttttgggagctcatttaggccaacagcaaaaaacgtaatatcctggaacaaaaactaaaaggaatcttatctgagaaaccgctttgtgatgtgtgcattcatatcacagagttaaatgatttttttcatttaacagtttggaaacacttcttgtagaatctgctaagggacatttgggagcacgttgaggcctgtgatgaacaaggaaacatcttcagataaaaactaaaaatatgctttctgagaaactactttgtgaggcctgcattcatatcacagagttaaacatttctttttattcagtagtttggaaacactgtttttgttcattctgggaatggaattttttaccttattgaagccaatggcgaaaaggtgaaaatcccaggataaaaactagaaggaagctatctgtgaaactgctttgtgatgtgtgcattcatcttgcaaagttaaatcttactttttattcagcagtttggatacagtgtttttgttgaaactgtgaagagatattttggagtgcattgaggcctatggtgaaaaaggaaacatcttcagataaaaactagaaagtaggtttcagagaaactgctttgtgatgtgtgcctttatcttggaattaaatctttcttttgattcagcagtttggaaacactctttttgtccattctgtgaatggacatttgggaaccctttgaggtcaatggtgaaaaagtgattatcccaggataaaaacgagaagacagctatctgagaaactgcttgtgattcatgcattcatctcatagagttaaacttttgtttttatttagcagtttgcaaacacttttttggtagaaacttcaaagggatatttgggagcacattgaggcctatggtgaaaaaagaaatatcttcagataaaaactacaaagaagatttctgagaaactgctttgttgtgtgtgcattcatctcagagaattaaacctttgtttggattcaggagtttggaaactctgtttttgtaaaatcttggaatggacatttagatgctcatggaggccaaaggtgataaagcgaatatcccagggtaaaacaagaagaaagctatttgagaaactgatttgtgatgtacgcattcaattctcagagaaaaacttttttttaaaattcctcagattcaaaacactgtttttgcagaatctgtgatgggatatttaggaggacgttgagaactacagtgaaaaaggaaatatcttcagataaaaactagaaagaatctttctgagaaactgctttgtgatgtgcacctttatctcacagagttaaaccttactttggattccacagtttggaaacactgttgttgtccattctgcgaatggattatatggagctcactgaggtcaaaggcgaaaaagtgaatatcccaagataaaatctagaaggaagctatctgagaaacagctttgtgatgtgtacattcatctcgcagagttaaaactttctttttattcagcattttggaaacatagttttcatagaatctgtgaaggcatatttgagatcacattgaggtctaacatggaaagggaaataactttagatagaaactagaaagaagctttctgagaaactgctttgtgatgtgtatcttcatctcacagagttaagtttttctgtgtattattcatccctttcaaaacactgtttttgtataatctgcaaagggatatttgaaagcacattgaggccagtggtgaaaaagcaaatatctcaggttaaaaactagaaggaagctgtttgagagacccctttatgatgtgcacactcatcttgccgaggtaaaagtttcttttcattcagcagtttggaagcactgtttttgcagtatctgtgaaggaatatttgggcatgcattgaggccagtagagaaaaaagaaaattcctcagataaaaactagagagaatcttttggagaaactactttgtgatttgtgcattcatctcacagagttaaacatttcttaagattcagcagttcagaaacactatttttgtccattctgtgaattgacattaggtagcactttgaggcccattgtgaaaaagtgcatatcccaggataaaaactagaaggaagctatttgagaaactgcttgttgatgtgtgcattcatctcacagagttaaacctttcttcttattcatcagtttggaaacactattttggtagaatctgcaaaaggacatttgggaggacatcaagacctatggtgaagatgaaataacttcagataaaaactggaaagaagctttctgagaaactgctttgtgatgggtgcattcatctcacagagatgaacatttctttggattcagcagtttggaaacactgttttcgtccattcagtgaatggacatttgggacttcattgaggccaacagtgagaaagtaaatatcccaggataaaaactataagaaaggtgtctcagaaattgatttgtgatgagtgcattcatctcacagagataaaactatatcttcatttagcagtttggaaacactgttaagtagaatctgtgaagggatatttgggggtgcatgaggtctatggtgaaaaaggaaatacattcagataaaaactagaaaggcgctttctgagtaccttcttcatgatgtatgcattcatctcactgatttaaacctttctttggattcagcagtttggtaactctgttcttgacaattctatgaaaggacgtttgggagctcatagaggccaatggtgaaaaagggaatatcccagaataaaaactaaaaggaaactctctgagaaaccgctttgtgatgtgtgaattcatctagcagcgttaaaactttcttttcattcagcagtttggaaacactgtttttgaagaaaccgtgaaaggatatttggcagcgcattgaggcctatggtgaaaaaggaaatatctttagataaaaactggacagaagcctactgagaaactgctttgtgatgagttcattcatctcacagagtgaaaactttgtttggcttcagcagtttggaagcactgtttttgtccattatgcgaatggatacttgggagctcattgaggccaaaggtgaaaaagtgaatatcccaggatagtaactagaaggacactctgtgagaaactgctttgtgacgtgagcattcatctcgcacagttaaacctttcttttcattcagcagttttgaaacgggttttgtagaatctgtgaatggatatttggtagtgctttgaggtgtatggtgaaaaaggaaatatcttcagaaaaaaaaactggaaaaaagctttacaagaaactgctttgtgatgtatgcaaccatctcacagagttaaacttttctatagattcagcagtttgaaaacagtttttgtccattgggtgaatggacatttgggagctcattgaggccaaaggtgaaaaagggaatatcccaggaagaaaactagaaggaagttatctgagaagccaatttgtgatgtgttcattcatctcaccgacttaaaaaattctttagattcagcagtttggaaacacggtttggtccattctttgaaggaacatttagaactcactgaggccagtggtgaaaaactgaatataccattataaaaagaagaaggaagttatctgagaaacgaatatgtgatgtgtggattcatctcacagaattaaacctatcttttcattcagcagattgtgaactctgtattcttagaatgtgtaaagagatacttggtagcaatctgaggactgtggtgaatgggaaatgtcttcagataaataccagaaataattttgaagagaaaatgctttgggatgtgcacattcatctcacggagtttaacattcctttggattcattagtttggtaacacagtttttcacaactctgcaaattgaattttgggagctcattgaggccaatggtgaaaaagtgaatatcccaggataaaaactataaggaagctctctaagaaaccgctttctgatgtgtgcattcaactcacagagataaaactttcttttcattcagcagtttggaaacactgttttcttagaaactgactaagaatacttggcagctcattgaggcctaaggtgaaaaaggaaatatcttcagataaaaacaagaaagaagctaaatgagaaactggtttgggatgtatgcattcatctctgagagttaaacctttctttggattcagcagtttgtaaacactgtttttgtccattcttggaaagtacattttggaactcattgaggccaatggtgaaaaatagaatatctcaggataaaaactagagggaagttacctgagaaatggtttcatgatgggtgcattcatctcacagagttaaacctttgttttcaatcagcagtttggaaacactgatttcttagaatctacgaagagatatatcatagcccattgaggcctatggtgtaaaaggaaatattttcagataaaaactataaaggaggttaaggagaaactggtttggcttgtgtgcattcatctcacagagttaaaactttctttggattcagcagtttggtaacactctttttgttcattctgtgaatggacttttggggggtcattgaggtcaatggtgaaaaagccaatatcccaggattaaaactagaaaggaagctatctgagaaatcacttttgatgtgtacattcatctagcacactttaactttcttttcattcagcagtttggaaacactgtttttgtagaaactgcaaaaggatatttggcagcactttgaggcctatggtgaaaaaggaaataacttcagataaaaactagaaagaagcttcctgagaaattgctttgtgaaatgttcatttatctcacagagttaaaactgtctttatattcagcagtttggaaacactattttgcccttttttggaatggaaatttgggaactcattgaggctaaaggtgaaaaagtgaatatcccaggaaaaatctagaaggaagttatctgagacaccgaatcatgatgtgtgcattcatctcacagagttaaaactttcttttcattcagcagtttgggaacactgatttctcagaatctgcgaacagatatttggtaacactttgagacctatggtgaaaagtaaatatcttcagataaaaaccagaaagaagcttaatgagaaactagtttgggttgtatgcattcatctcacagaaataaacctttctttggattcagcactttggaaacgttgtttgtgtccattctgtgaaaggatgtttttaagctcattgaggccaatggtaaaaaagtgaatatcccaggactaaaactaaaaggaagctatcagagaaactgccttgtgatgtgtgcattaatctcacagaattaaacctttctttggattcagcagtttggtatcatgaatgtgtccattttgtgaatagccatttgggatctaattcaggccaaaggctaaaaagcaaatatcccaggataaaaactagaagaaagatatctgacaaactgttatgtgatgtgtaccttcatctcacagaattaaacgtttcttttcattcatcattttggaaacactgttttggtagaatctgcaaagggatatttggaagtgcattgaggcctatagtgtaaaaggaaacatcttcagataaaaactagaaagaagctttcggagaaactgctttgtgatgtgtgcatttatctcagagagctaaacctttcttttgattgagcagtttggtaaccctgtttttgtacattatgaaagtggacattttggagctccttgaggccaagggtgaaaaagtgaatattccagcataaaatgtagaaggaagctaacagaaaaaccactttttgatgtgtgcattcatctccagaattaaacattaattttcattcagcagtttgaaaacactgttttggtagaatctttttttttttattatactttaagttttagggtacatgtgcgcattgtgcaggttagttacatatgtatacatgtgccatgctggtgcactgcacccactaactcatcatctagcattaggtatatctcccgatgctatccctcccccctccccccaccccacaacagtccccagagtgtgatattccccttcctgggtccatgtgatctcattgttcaattcccacctatgagtgagaatatgcggtgtttggttttttgttcttgtgatagtttactgaaaatgatgatatccaatttcatccatgtccctacaaaggacatgaactcatcattttttatggctgcatagtattcctggtgggactgtaaactagttcaaccattgtggaagtcagtgtggcgattcctcagggatctagaactggaaataccgtttgacccagccatcccattactgggtatatacccaaaggactataaatcatgctgctataaagacacctgcacacgtatgtttattgcggcattattcacaatagcaaagacttggaaccaacccaaatgtacaacaatgatagactggattaagaaaatgtggcacatatacaccatggtagaatcttttcagaggtacttgggagtgctttgatgtctatggtgaaaaaggaaatgtgtttagatgaaaactagaaaaaagttttctgagaaactgctttgtgatgtgtgcattcatctcacagagttaaatctttctttggattcatgaatttggaaacactttttttgtaaaatccatgaagggatatttgtgagttcattgaagccaaaggacaaaaaatgaatatcccaggataaaaactagaaggaagccatctgagaaaccgctttgtgatgtgtgcatacaccttacagtgttaaacatttcttttcattcagcagtttggaaacaatgttttcatagactctgtgaagtgatatctgggagaaatttgaggcctataatgaaaaaggaaatatcttcagatcaaaactataaagaagcattctgaggaactgctttatgatgtgtgccttcatctcacagagttaaacctttctttggattcagcagtttggaaacactgttgttgttgaatctatgaagggatatgtgggagctcactgaggccaatggtgaaaaagaaaatacaatcagataaaaactgtaaagaagctttcttagaaactgttttgtgacgtatgcttcatctcacagagttacacctttctttgaatttagcattttggaaacactgtttttgtagaatctgtgaatggatattagatagctcatagaggccacagatgaaaaagcaaatatctcagtttaaaaactagaaggaagctatctgagaatccaatttgtgatgtttgcattcatctcacagagttaaacctttatttacattaagctctttggaaacattgttttggtaggatcagataaaaactagaaagaaggtttctgagaaattgctttgtgacatgtgaatttatctcacagagttaaacctttctttggattcagcagtttagaaacactgtttttgtagaatctgctaagggatttttaagagctcattgaggacaaaggtgaaaaagcaaatatctcaatataaaaagtagaaggaagctatctgagaaacgttgcgtgatgtgtgcattcgtctcacagagttaaacctttcttttcattcagaagtttggaaacacttttggtagattctgtgaagggatatcagcgagtgcattgaggactatggtgaaaaaggaaataccttctgataaaaactagaaagaaactttctgataaaccgcttcatgatgtgtgcattcatttcacaaagttaaacctttcttttgattcacctgtttggaaacactgttttcttataacctgtgaaggggtatttcggggcttgttgaggccaaaagcaaaaaagcaaatatctcaggataaaaagtagaaggatctatctgagaaatcactttgtggtgtgcacattcatctcacagagttaaacctttctttctattcagcagtttggaaacactgttttggtagaatctgcaaagggatagttgggagcccattgaggcctatggtgaaataggaaataacttcagttaaagactacaaagaagctttctgagaaaacactttccattgtatgcattcatctcattgaagtaaacttttctttggattcagcagtttggatacacagtttttgtagattctgcaaaggtatacttgatagctcattgaggccacaggtgaaaaagtgaatatcccaggataaaaattaggaggaagcaacctgagaaatcactttgtgatgtgttcattttctcacagagtttaaaattacttttcattcagcagtttgtatacacagtttttgtggaatctgcgaagggattttaggaagctcattgccacctatggtgtagaaaaaaataacttcagataaatacaagaaaggagatttctgagaaactactttctgatgtgtgcattcattttacagagttaaacctttctttgtatttagcagtctggaaccactgtttttgtagaatctgcagagggatatttgggagctcattgaggccaaaggtgaaaagagaatatctcaggataaaaaaatagaaggaagctatctgagaatcatctttgtgatgtgtgcattcatctcacagagttaaacctttcttttcatccagcagtttggaaatactgttttggtagaatgtgtgaaaggatatttgggagtgcattgaggtatttagtgaaaaaggaaatatctccagaaaaaaacaggaaagaagctttctgagaaactgctttttgatgtgtgaattcatttcacagctttaaaaatttattttctttcagcagttgtgaaacacctgtttcagtagaatctgtgaagggatatttgggagcgcattgaggcctatggtgaaaaaggaaatatcttcaaataaaaactagaaagaagatatttgagagactactttgtgatgtgtgcattcatttcacatagttgaaactttcttgggattcagcagtttgtaaacactgtttttgtggaatttgcaaagggatatttgatagctcatggaggccaatggtgaaaacatgcacatctcagtataaaaactggaaaggaaatatctgagaaaccactttgtgatgtatgtattcaattcacagttaaacctttattttcattcagcagtttgggaacactgtttcagtagaatctgtgaagggatatttgggagcacattgaggcctgtggtgaaaaagataatatgttgagattaaaaactagaaaaaatccttgtgagaaattgctttctgatgtgtgcattcatgtcacagctttaaacttttctttggattcaggagtttggaaaccctgtttttgtagaatctgcaaagagatatttgggagcgcattgaggcctaaggtgaaaaatcgaacatcacaggaaaaaaaaaaaaacagaatgaagctatctgagtaactgctttgtgatgtgtgccttcattcagcagaactaaaattttcttttccttcagctgtttggaaacactgttttggtagaatctgaaggggacatttgggagcccatggggaccaatggtaaaaaaaggaaacatcttcagaaaaaactagaaagaagctttctgagaaactactttgtgatgtgtgtgttgatctcacagattaaaactttctttgggttcagcagtatggaaacactctatttgtagaatctgcaaaggaatatttgggagctcattgaggtcaaattgaaaaagtcaatatcccaggataaaatcaagaaggaagctatatgaaaacagctttgtgatgtgtgcattcatcttacagtgttacattttccttttcattcagcagtttggaaacactattttttctaaaatctgtgattgaatatttggcagctaattgaagcctatggtgaaaaaggaaataacttcagataaaaaatagaagctttctgagaaactgctttgtgatgtgttcattcatttcacaaagttaatccttcctttggattcagcattttggaaacactgtttttatctattctgtgaatggacttttgggaactcattgaggccaatgatgaaaaagttggtatcccttgataaaaactagaaggaggttatcttagaaaccgactggggacatgtgcattcatttcacagggttaaactttgctttacattcagatatttggaaaaactgttttcttagaatctgtgaagagatatttggtagtgcattgtggtctagggtgaaaaaggaattttcttcagatcaaaagtagtaagaagcttaatgagaaactgctttgggatgtgttcatctatcacaagagttaaagctttctttgaattcagaagtttgaaaacacagttttcgtccactctgcgaatggatattggggaacttattgtggccagggcaaagaagtgaatatcacaggttaaaaactagaaggatttaatctgagaaaaagatctgtgatgtgtgtgttcatctcaaagacttaaacatttcttttcatgcagcagtttggaaatactgttttcttagaatgtgcaaagagatacttgttagtgccttgaggcctatggtgaaacacgaaatatctgcagataaatactagaaagaagcttaatgagaatctgctttggtttgtgttcattcatttcacagagttaaaacttcctttggattccacagtttggaaagactgtttttgtctattcggcaattggacatttgggaacacgttgagtcctatggtgaaaaaggaaatatattcagataaaaattagaaagaagctttctgagaatctgctacattatgtgcgcatttacctcacagtgttaaaactttctttggattcagccatatggaaacactgtttttgtccattctgtgactggacatttgggatctcattgaggccagtggtgaaaaatgggatatcccaggataaacaatataaggaagacatctgtgaaactgctttgttttgtgtgcattcatctcgcagagttaaaactttcttttcactgagcagtttgaaagccaggtttttgtagaatctgtgaagggatatttgggagcgctttgaggcctatggtgaaaaagggaatatattcagataaaaattagaaagaagctttctgagaaactgctttgagatgtgttcattcgtcttacacagttaaatctttgtttggattcagcagtttggaaacactgtttttgttcattgcacgaatggacatttgggagctcattaagggcaatggtgaaaaagagaacatctcagaataaaaactggaagcacgttatctgagaaactgatttctgatgtgagtattcaactcacagagttaaaacttgcctttcattcatcagtttggaaacactgttttattttattttgttttattttattattattatactttaagttttagggtacatgtgcacaatgtgcaggttagttatatatgtatacatgtgacatgctggtgtgctgcacccattaactcgtcatttagcattaggtatatctcctaatgctatccctccccactcccctcaccccacaacaggccccagagtgtgatgttccccttcttgtgtccatgtgttctcattgttcaattcccatccatgagtgagaacatgcggtgtttggttttttgtccttgcgatagtttactgagaatgatgatttccaatttcatccatgtctctacaaaggacacgaactcaccattttttatggctgcatagtattccgtggtgtatatgtgccacattttcttaatccaatctatcattgttggacatttgggttggttccaagtctttgctattgtgaatagtgccgcaataaacatacgtgtgcatgtgtctttataacagcatgatttatagtcctttgggtgtgtacccagtaatgggatggctgggtcaaattgtatttctagttctagatccctgaggaatccccacactgacttccacaatggttgaactattttccagtcccaccaacagtgtaaaagtgttcctatttctccacatcctctccagcagctgttgtttcctgactttataatgatcgccattctaactggtgtgagatggtatctcattgtggttttgatttgcatttctctgatggccagtgatagtgagcattttttcatgtgttttttggctgcacaaatgtcttcttttgagaagtgtctgttcatgtcctttgcccactttttgatggggttgtttgtttttttcttgtaaatttgtttgaataccatgctgttttggttactgtagccttgtagtatagtttgaagtcaggtagtgtgatgcctccagctttgttcttttggcttaggattgacttggtgatgcgggctcttttttgattccatatgaactttaaagtagttttttccaattctgagaagaaagtcattggtagcttgaaggggatggcattgaatctataaattaccttgggcagtatggccattttcacggtattgattcttccaacccatgagcatggtatgttcttccatttgtttgtattctcttttatttcattgatcagtggtttgtagttctccttgaagaggtccttcacgtcccttgtaagttggattcctaggtattttattctctttgaagcaattgtgaatgggagttcactcatgatttgcctctctgtttgtttgttattggcctataagaatgtttgtgatttttgcactttgattttatatcctgagactttgctgaagttgcttaccagcttaaggagattttgggctgagacagtggggttttctagatatacaatcatgtcatctgcaaacagggacaatttgactttctcttttcataattgaataccctttatttccttctcctgcttgattgctctggccagaacttccaacactatgttgaatagaagtggtgaaagagggcatccctgttttgtgccagtatacaaagggaatgctttcagttttggcccattcagtatgatattggctgtgggtttgccatagatggcttttattattttgagttatgtcccctcaatacctaatttattgagagtttttagcatgaagtgttgttgaattttgtgaaaggccttttctgcatctattgagataatcatgcggtttttgtctttggttctgtttctatgcttaattacatttattgatttgcatatattgaaccagccttgcatcccagggatgaagcccactcgatcattgtggataagctttttgatgtgctgctggatttggtttgccagtattttattgaggatttttgcatcaatgttcatcaaggatattggtctaaaattctcttttttggttgtggaaacattgttttcttagaaactgtgaagagacatttggaaatgtaatgaggggtgtagtgaaaaaggaaatctcttcagataaaaactagaaagaacctttctgagacactgctttgtgatgtgtgcattcatctcacagagttagtcctttctttggtttcagcaatttggtaacactgtttttgtccattctgtgatggacattttggagctcatggaggccaattgcaaaagagcgaatatcccaggataaaaactagaaggaatttatctgagaaactgatttgtcatgtgtgcattcatctaacacaattaaacatttttcattcagcagtttggaaacactgtttttgtagaatctgtgaagggatatttggcacttcattgaggcctatggtggaaaatgtaataccttcagataaaaactagaaagaagctttctgagaaactgctctgtgatgtgtgcactcgtctcacagagttaaaattttctttggattgagcagtttggaaaactgtttttttccattctgtgaatggacatttgggagatcattgaggccaatggtgaagaagtgaatatcccaggataaaaactagcaggaagatatatgagaaaatgctttgtgatgtgtgcattcgtcttgcaatgctaaatatttcttttcaatcataagttttgaaagtgtttttgtagaatctgtgtagggatatttggcagtacagagtggcctatgtttaaaaaaggaaatatcttcagataaacacttaaaagaagctttctgagaaactattttgtgatgtgttcattcatctcacagagttaaatctttttttttaattcagctgtttggaaacactattttcttagaatctgtgaaaagtcctttaatattgcattgaggcctacggtgaaaaaggaagtatcttcagataaaaattagaatgaagctgaattaggaactgctttggaatgtgtgcattcgtctcacagagggaaacatttcttaagattcagcagttcagaaacactgtttttgtccattctgtgaatgaatattgggaacacctcgagaccaaagctgtgcattcacctcacattgttcaaccttgttttcattctgcagtttggaaagactcttttattagaatctgcgaggatatatttgatagccattgaggtttatagtgaaaaaggatatatcatgagatataaactagaaagaagcttaatgagatactgctttgggatgtgtgcattcatctcacagtgttaaaagtttcttttgattcagcagtttggtaacactgttttgtctattctgccaatagacattggggagctccttgaggccaatgatgagaaactaaatatcccaagataaagactagaaggaattatctgagaaaccgatttgtgatgtgtgcattcatctcagagatttaaacttttcttttcactcagctgattggaaacatgggtttcttagaatctgcgaagaggtatttggtagtgcattgaggcctatggtcaaaaaagaaatatgttcaaatcaaagatagaaagaaacttaatgagaaactggtttaggatgtgtgcattcatcttcacagagttaaaccttttttgaattcagctgtttggtaacactgttattgtcaattctgtgagttgacatttgggagctctttgaggccaatggctaaaaagtgaatgtcccaggataaaaactagaaggaagcaatctgacaaactgctttgtgatgtacacattcatctcacagagttgaaactttctttgcattcagcagtttgaatacaccgtttttgtagaatctgcaaagggatattgggcagggcattgatgccgatgttgaacaaaagatatcttcagatgaaaactagagaccaactttctgagaaactgctttgtgaggtgttcactcacttcacagtgttaaatctttctttggattcagcaatttggaaacactgtttttgtccattctgtgaatggacatttgggagctcattgaggccaatggaaaaaaagcgaatatcccatggttaaaaactacaaggaagttatctgagaaacggatttgtgatgtgtgccttcatctcactgatataacctttcttttcattcagcagtttggaaacactgtttcttagaatctgcgaagaaatatttggtattgcattgaggtctattatgaaaattgaaatatcttcagaaaaaaacaagaaagaagcttaatgagaaactgtttttggatgtgtgcattcatctcactgagttaaagcattcttttcattcagcactgtggaaacaccattttcttagaatccacaaagagatatttggcagccctttgaggaccatggtgacaaaggaaatatcttcagataaaaactagaaagtagctttctgataatccattttgtgatctgtgaattcatctcacagagttaaacctttctttggattcagcagtttggaaacactgcattcttagaatctgtgaagagatatttggcagcgcatttaggtgtatgttgaaaaaggaaatatcttcagataaatactagaaagaaactttctgagaaactgctctgtgatgtgtccattcatcccagagagttaaacctttctttggattcagcagtttggaaacactgtttttgtctattctgtgaatagacatttgggagctcattgagttcaatggcaaaagagaaaatatcctaggacaaaaaactagaaggaagttatctgagaaacagattgtgatgtgtgcagtcatctcacagagttaaaactttcttttcatttggcagtttggaagcactgtttccttaaaatctgtgaagagacatttggtaacgcattgaggaccatggtgaaaaaggaaatatcttcagataaaaactagcaagaaactttctgagaaactgctttgtgatgtgttcattcttcttgcagatttacagctttctttggattcagcagtttggaaatactgtttttgtccattttgtgaatggacattttggagctcattgaggccaatggcgaaaaagtgaatatcccaggataaaaactagagggaagttttcatggaaaacgattcatgatgtgtgcattcatctcacagagtttaatctttctttttattcagcagtttggaaatagtgttttcttaaaatctgccaagagatatttggaagactatacaggcctatggtgaaaaaggaagtattttcagataaaaactggaaagaagtttaatgagaaacttctttgtgatgtgtgccttcatctcagagaattaaacctttctttggattcagtagtttggaaacacagtttttgtccattctgctaaagggcattttgaagctcattgtggccagtggtgaaaaagcaaatttcccagcataaaaactagaaggaagatgtcagggaaaccaattcatgacgtgtgcattcatctcatcgagttaaatctttctgttcattcagttgtttagaaacactgttttcttagcatctacaaagagatgtttggaagagtatgaaggccaatggtgaaaaagggaatgtcttcagataaaaactagaaagagcataacgagaaaatggtttgggatgtgtgcattcatctcagagagttaaacttgtgtttgtattcagcaggttggaaacacagtttttgtccattcttggaatggacatttgggaactcattgaggccaacggtgaaaaagcaaatatcccaggataaaaattggaaggaacttatctgagaaaccaattcatgatgtgtgcattcatctcacagagttaaaattttcatttcattcagcaggatcgaaacactgatttcttaggatttgcagagagacaattggtagtgcatttgggtgaaaaaaggtatatcttcagataaaaactagcaagaagctttctgagaaactgctttgtgatgtgatcattcatccaaaatagttaagccattctttggattcagcagtttggtaaaactgttttcgtccattctgtgaatggatttttgggagctcattgaagccaaaggtgaaaaagagaatagcccatgataaaaaatgaaaggaagcaagctgagaaactgctttgtgatgtgtgcattcacctcacagtgttaaaaacttcttctcattcagctgtctggaaacattgttttggcagaatccaggaagggatatttgggagtgcgttgaggcctatggtgaaaaaggaaacatcctcagaaaaaaacaagaaagaagctttctgagaaactgctttgtgatgtgtgcattcatctcacagtgttaaaagtttctgtggattcagtagtatggaaaactgttgttgtagaatccttgaagagatattttgaagctctttgaggccaatggtgaaaaagagtatatcccaggataaaaactagaagaaagctatctgaggaacagctttgtgatgtgtacattcacctctcagagataaacctttcttttcattcagctgtcaggaaacactgttttggcagaatctaccaagggatatttgggaatggatagaggcctatggtgaaaaagaaaatatcttcagataagaactagaaagaagctttctgagaaactgtttttaatgtgtgcattcatctcatagagttaaacatttctttagattcagtagttggaaaaacatttgttttagaatctgagaacagatatttgggaaatcattgaggccaatggtgaaatagcaaatatcccaattataaaaactagaaggaggatatttgagaaaccgtcctgtgatgtgtacattcatctcaaagacttaaataattcatttcattcagcagtttagaaacactgttttcgtggaaactgttaagggatatctgggagcgtattgaggccaatggcaaaaatggaaatgacttcagataaaatctaaaaagaagctttctagaaagtcctttatgatgtgtgcatttatgtcacagagttaagcctctctgtggattcagcagtttgcaaacactgtgtttgtcctttctgtgaaaggacatttgcaagctcattgaggccaattgcaaaaaagacaatatcccaggacaaaaactggaaggaagctatctgacaaaacacgttgtgatgtttgcattcacatcgcagagataaacgtttcttttcatacagcagtctgaaagcactgtttaggcataatctgtgaagggatatttgggtgtgcattgaggtctatggtgaaaaaggaaatatcttcagataaaaacaagaagaagctttctgagaaactgctttgagatgtgtgcattcattttgcagtgttaaacctttcttttcattcagcagtttggaaacaccgtttttgtagaatctgtgaagtgatatctgggaacacattgagacccatagtgaaaaaggaaatatcttcagataaaaactataaagatgctgcctgagaaactgctttgtcatgtgtgcactcacttcacagagttaaaactttctgtggattcagcagtttgcaaaaactgtttttgtccattctgtgaatggacatttgggaactcattgaggccaatgtgagaaagagaatatcccaggataaaaactggaaggaagctctctgacaaattgctttgtgatgtgtgcattcaactcacagaaataaacctatcttttcattcagcagcctggaaacactgatttggcagaatccaggaagggatacttctgagtgcattgaggtctttgatgaaaaaggacataacttctgataaaagcaagaaagaagctttctgagaaactgttttgtgatgtgtgtattcatctcacagagttaaacctttcttttcattcggcaatttggaaacactcttttcatagaaactgtgaagtgataactgggagtgcattaagtcctatggtgaaaaaggaaatatcttcatataaaaagtacaaagaagctttctgagaaactgctttgagacgtgtgcattcatctcaaaagttaaaccttctgtagattcagcagtttggaaacactgttgttgtagaatctgcaaagggaaatgtgggaatgctttgaggccaatggcaaaaaagcgaatatcccaggaaaaaaactagaaggaagctatttgagaaattgctttatgatgtgtgcactcatttcacagagttaatcctttcttttcactcaacagtttggaaatactcttttcatagaatctgcaaagggatatctgggagtgcattgaagcatgtagtgaaaaaggaaatatcttcagataaaaactataaagatgctttctgagaaactgctttgtgatatgcagattcatctcagagttaaacctttctttggattcagcaaatcagaaacactgttgttgtagaatctgtgaggggatatttgggaacacattgaggccagtggtgaaaaagtgaaaatcccaagataaaaactagaaggaatgtatctgagaaaccactttgtgatgtgtgcatttatctcacagaggtaagactttcttttcattcagcaatgtggaaacactcttttggcagaatctgtgaagggatatttaggagctcattgaggcatatggttaaaaaggaaatatcttcagataaaaactagaaagaagctttctgaggaactgctttgggatgtgtgcattcttcttatagagttaaaactttctgtaaattcagtattttgcaaacactgttgttgtagaaactgtgtagggatatttgggaacgcattgaggtcaacagtgaaaaagcgaatatccctggataaaactagaaggaagctatgtgagaaaccactttgcaatatgtgcattcatcttgaacagttaaacctttctattcactcagcagtttggaaacactgttttcctataatctactaagggatatctggtggtgcattgaggcttatagtgaaaaaggaaatatcttcaggtaaaaactagaaagaagctttctgagaaactgcattgtgatgtgtccattcctctcacaaagttaaacctttctttggattcagcagtttggagacactgtcattgtagaatctgtgaagggatgtttgggagcttaatgaggccaaagtcgtataaccaaatatcccaggaaaaaaactagaaggagacgatctgcaaaaccgttttgtgatgtgtactttcatctctcagaattacaactttattttaaactttctagtggattcagcagtttgtaaacactgttttggtctattctgcaaatgtacatttgggagatcaatgaggccaatggaaaaaaataaatatcccaggataaaaaggagaaggaacctctgtgagaaacggctttctgacgtgtgcattcatcttgcagagttgaacctttcatttaattcagcagtttgaaaacactgttttcaaagtatctgcaaggtgatatttgggagtgcattgacgcctatggtgaaaaaggaaatatcttcagatgaaaactacaaagaagctttctgagaatctgctttgtgatgtgtgcattcatttcacagagttaaacctttccatggattcagcaatttgcagacactgtttttgtccatcctacgaatggacatttggggctcattgaggccaatggcaaaaaagtgaatatcccaggatgaaaaatagaaagaagctatctgctgagaaaccactttgtgaagtgtgaattcacctcgcatagttaaaactttcttttaatacagcaatctggaaacactgttgtggcagaatctgccaagggatatttgggagtgctttgagacctatggtgaaaaactaaataacttcagataaaaactagaaagaagctttctgagaaactgctttgtgatgtgttcattcatctcacagaattaaaactttctgtggattgagcagattgcaaacactgtttttgtccactctgcaagtatacattttggagctctttgaggccaatggaaaaaaaatgaatatcccaggataaaaactggaatgaagctgtatgagaaaccgctttgtgatgtaagcattcatcttgcaagttaaatgtttcttttcattcagcagtttgaaaacactgttgtcgaagaatctgcaaagtgatatctggaagcacattgaggcctattgtgaaaaaggaaatatcttcagatacaaactagaaggaagctttctgagaatctgctttgtgaagtgttcattcatctcacagagctaaaactttatgtggattcagcaacttgcaaacactgtttttgtccattctgcaaatggagatttggtagctactcgaggccaatggtgaaaaagtgaatatcccaggataaaaagtagaaaaaagctatctaagaaactgctttgtgatgtgtggattcacctcacagtgttaaaattttcttttcatacagcagtctggaaaaactattttggcagaatccgggaaaggatatttgggagtacatcacagactatggcgaaaaagtaaacatcttcagataaaaactagaaaagacgttcttagaaacagctttgtgatgtgtgcattcatctgccagagttaaacctttctttggattcagcattttggaaacactgctgttgtagaatccacaaagggatatttaggaattctttgaagccaatggtgaaaaaatgaatattgtaggacaaaaactagaataaagctatcagagaaactggtttgtgatgtgtgcattcacctcagagagttaaacctttcttttcattcagctgtttggaaacactcttttcatagaatgtgcgaagggatatctgggagcgcattcaggcctacggtgaaaaaggaaatatcttcggataaaaactagaaggaagctttctgaaaaactgctttgtgatctgtgtattcatctcacagatttcaacctttctccggattcagcagtttgcaaatgcagtttttgtccattgtgtgaatggtcacttgggagctcattgaggaaaacggcaaaatagggaatatcccaggataaaaactagaatgaaactatctgagaaattgctttgtgatgtgtgcattcacctcgcagagataaagctttccccttattcagcattttagaaacactgttattgtagaatctgtgaacttatatttggaagcacattgaggactatggttaaaaacaaatatcttcagaaaaaaactagaaagaagctttctgagaaagtgctttgtgatgtgtgaatttacctcccagaattaaacatttctgcagattcagcagtttgcaaacactgtttttgtccattctgcaaatggacatttgggagctcattaaagccaatgttgtaagagaaaatatcccaagataaaaactggaaggatgctatctgagaaaccgctttgtgatgtgtgcattcacctcacagagataaacttttcttttcattctgcagtctggaaacactgttttgaaagaattcatgaagggatatttgtgagcacatggaagtctatggttaaaaaggaaatatcttcggataaaaacaagaaagaagctttctgagtaagtgcttagtgacctgggcattcatctcacagagttaaacctttctgtggattcagaagcttgaaaacactgtttttgcccattctgcaaatggacatttgggagctcattgaggccaatggcaaaaaagtgaatatcccaggaaaaaaactagaagaaagctatctgagaaaccgctttgtgatgtatgcattcatccctaagactgaaacctttattttcattctgcagtttggaaaaactgttttcatagaatctgcgaggttatatttgggagtgcattttctgagaaactgctttgtgatgtatgcatacatctcacagacataaaactttctgtggatttagcagtttggaaacactgtttttgtccattgtgcgaatggacatttgggagctcattgtggccaatggtgaaaaagcatatatccaagggaaaaactagaaggaaggtatctgagaaactgctttgtgatgtgtgcattcatctcagagagttcaacctttctgtgcattcagtagtttgaaaacactgtttttgtcctttctgtgaatggacatttgggagctctttgaggtcaatgggtaaaaagagaatatcccagaataaaaagtagaaggaagctacttgataaaccgctttgtgatgtgtgcattcatctcacagagttaaacatttcttttctttcaggagtttaaaaacactgttttcatagattctgcaatgggatatctgggagcacattgaggcttatgttggaaaagaaaatatctttagataaaaagtagaaagaagctttctgacaaactgctttgtgatgtgtgcattcacctcacaggatcaaaactttctgtggattcagccgtttgcaaaactgttttgtccattctgtaaatggacatttgggattcctttgaggccaatggcacaaaagcgaatatcacaggataaaaactagaaggaagttatctgacaaaacgctatgtgatgtatgcattcacctcacagagataagcctttctttcattcagcagtctggaaacactgttttggcacaatcagcaaagggatatttgggaatacttagaggcctatggtgaaaaaggaaataccttctgataaaaactagaaagaagatttctgagaaactaatttctgatgggtgcattcatctctcagagttaaaattttctttccactcagcagtttggaaacactgtttttttttccattctacgaatggacattttggagttcattgaggccaatggtgaaaaagtaaaaatcccaggatagcaactagaaagagtctatctgagaaaccactttgtgatgtgtgcgttcacctcacagagttaacaatttctttgtatatagcagtctggaaacactgttttggcagaatctgtgaggggatatttgaagcgcattgaggcctatggtgagaaagaaaataacttcagataaacaatagaaagaagcattctgaggaaatgctttctgatgtgtgcattcatcttaaagagttaaaattttctgtggattcagcagttggaaaacactgtttttgcccattctgtgaatggacgttttggagctattgaggccaaaggcaaaagagtgaatatcccaggataaaaactagaaggaagttatctgaaaaactgctttgtgatgtgtgcattcatcttgcagagataaacctttcttttcattcagcagtttggaagcactgtttttgtagaatcgtgaagagatatttgggagcttaatgaggcccaggtgagaaagtgaatatccaaggaaaaaaaacaagaaagaagctctctgagaaaccactttgtgatgtgtgcattcaactcacagaggtaaaactttattttcattcatccatccagaaacactgttttggcaggatccatgaagggatatttgggagcccattgaggcctatgctaaaggggaaatatcttcagataaaaacaagaaagtagctttctgagaaactattttgtgatatgtgcattcatcacccagagttaaatttttctttttattcagcagtttggaaaatgttgtggaatctgcaaagtgatatttgggagctcattgaggccaaaggcgaaaaagtgaatatcccatgatgcaaactggacggacaccatctgagaaactgctttgtgatgagtgcattcatctctctgagataaatcttacttttgattcagcagtttggatacactctttttgtagaatctgcgaagtgatatctgggaccgcatggaggcctatggtgaaaaaggaaatattttcagataaaaactagaaagaagctttctgggaaactgctttttgatgtgtgcattcacctcacagagttaaatatttctgtggattcagtagtctgcaaatacagttttgtacattctgtgagtggacatttgggaactcaatgaggcaaatatgaaaaagcaaatataccaggataaaaactagaaagaagcaatctgagcaacttctttgcgatgtgtgcattcacctcacagagataaacttttcttttcatttagcagtcaagaaaccctgttctggaaggatctgtgaagagatatttgggagtgcattgagcactatggttaaacaggaaatatccacagataaaaactagaaagaagctttctgagaaagtgcttattcatctgtgcattcatctcacagaattaaatatttgtgtggattcagtagttttgcccgatctgcaaatgcacatttgggagctcattgaggccaaaggccaaaaaagtgaatatcctggggaaaaaaaagctagaaggaagctatctgagaaaccgctttgtgatgtgtgcattcaccatgcagagataaacctttctttccatttagcagtttggaaacactgttttgtagaatcagcgtagttatattttagagtgcattagggactctgtttaaaaggaaatctcttcagagaaaaaatgaaagtagctttctgagaaagtgcttagtgatgtgcgcattcatctcacaaaattatacatgactgtggattcagtggtatgaaacccatgttattttccattttgcaaatagacattttggagttcaataaggccaatgggggaaaaggaaatttcttaggataagaactagaaggaagctctttgagaaactgctttctgacttgtgcattcatctcacagggttaaacctttcttttcattcagcagtctggaaacattgctttggcaatatccgagaagggatatgtgggagtgtattgaggcctaacatgaaaaaggaaatatcttaagataaaaactagaaagaaaccttctgagaaattgctttttgatgtttgcattcgtctcccagaattaagcctttctttggattcagcgttttggaaacaatgttgttgtagaatctgtgaagggatatttgagagcttaatggggctaatggggaaaaacggaataaccagcaaaaaaacgtgaaggaagttatctcagaaactgctttgtgatgtgtgcattcagctttcagagttaaacctttcttctcattcagcagtttggaaacactcttttcatagaaactgtgaagtgatatctgggagcacctagaggcctatggtgaaaaaggaaatatcttcagataaaaactagaaaggtgttcttggagaaactgcttcgtgatgtctgcattcatctctgagaggtaaacctttctttggatttagcaatttagagacactgtttttgtagaacctgcaaagtgatatttgggagctcattgaggccaacgccataaaagccaaaatcccaggataaaaactagaaggcagttatctgagaaatggctttgtgttgtgtgcattcatctcacagagataaacctttcttttcattcagcagtttggaaatactgttttggtagaatctacaaagggatattttgtagagcattgatgtctgtggtgaaaaagaaaatatattcggataaaacctagaaagatgcttttttagaagctgctttgctatgtgtgcgttcatcttgcagagtgaaacctttctttggattcagcagtttagaaatactgtttttgtagaatctgcacagtgatatctgggattgcattaaggcctatggtgaaaaaggaaataccttcagataaaaactagaaagaagttttctgagaaactgctttgtgatgtgtgcattcatctcacacagttaaacctttctgtagattcagcagtttgcaaacactgtttttgtttttccatactgtaaatgaacacttgagagcttattgaggccagtaatgaaaaagggaatatccaaggagaaaaaacagaaggaagctatctgagaaacctctttgtcatgtgtgcattcacctcacagagttaaaaccttcttttctttccacagtctgtaaacactgttttagcagaatccatgaagggatatttgggagtgcattgaggcctattgtgaaaaaagaaaataccttcagataaaaactagaagtaagctttctgagaaactactttgtgatgtgagcattcacctcacagagttaaacctttctgtggattcggccatttgcaaatacttttttgtccattccgcaaagggatatttgtgagcgcattatgacctatggtgaaaaagaaaataccttcacataaaaattacaaaaaatgtttctcagaaactgctttgtgatgtgtgcattcatcccacacagttaaacaatttttggactcagcagtttggaaacactgtatttatagaatctgagaaggcatatctgggaactcattaagaggaatggtgaacaagcaaatctcagaggaaaaacactagaaggaagcaatccgagaaactgctttgtgatgagtacattcatcacacagagttaaagctttcttttcattcagcagtttggaaacactgttttcattgaatctgcgaagtgctatctgggagtgctttaaggcctaccgtgaaaaagaaaatatcttcagataaaaactagaaataagcatcctgataaactgctttgtgatgtgtgcattcatctcccagagttaaaccattctttggattcacctattaggaaacactgttgttttacaatctgtgaagggatacttgggagctcattgaggacaaatgtgaaaaagcaaatatcccattacaaaaactggaaggaagctatctgagaaaccattttgtgatgtgtacattcatctcacagagataaatctttctttttcattcagcagtctggaaacactattttggcatgatccacaaagtgatatttatcaccacatggaggcctatgatgaaaaaggaaataacttcagataaaaactagaaagaagctttttgagaatctgctttgtgatgtgtgcattcttctcacagagttaaaccattctatggattctgcagtttgcaaacatggtttttgcccattctgcaaatgggcatttgggaactcattgagggcaatggcaaaaaagcgaatatccaaggatataaactagaaggaagctacatgaacctcacagagataagccttccttttcatacagtagtgcggaaacactgtttttgcagaatccattaagggatattagggagtgcattgaggcctatggagaaaaagtaaatatctgcagaataaaactggaaagaagctttctaagaaactgctttgtgatatgtgtattcatctcacagagttaaacatttcttgcattcaacagtttggaaacattgttgttgtagaatctgcaaaggtatatttgggacctcattaaggcccatggtgaaaaagccaatatcccaggataaaaagtataaggaagccatctgagaagccactttttgttatgtgggcattcacctcacagagttaaaccatttatttcattcagcagtccagaaacactgttttggcagaatgcttgatgggatatttgggagcgcattgaggactgtggtgaaaaagtaaatatctgttgaatcagcagtttggaaaaactgtctttgtctattctgtgaatggacatttgggagtgcattgaggcaaatggtgaaaaagcaaatatgccaggataaaaactagaaagaagctacctgagaaacaactttttgatatgcacattcaccacccagagtaaaaactttcttttcatacagcagtctggaagcactgtttttgtagaatatgcaaaataatatttcggagttcatagaagtctctgcaggcaaaggaaatatcttcagataaaaagtagaaagaggctttcagagaaacatctttgtgctgtgagaaatcatctcacataattcaacatttctttggattaagcagtttggaaacactgtttttgtccattctgcaaatggacatctgggagctcatcgaggccaatggcaaaaatgttaaactttcagcagtttggaaacactgttttcgaagaatctgtgaagggatatctgggagctcattgaggccaatggtgaaaatgtgaataccccaggataaaaaatagaagtaagctatttgagaaactgctttgtgatgtgtgcattcaactcacagagttaaacttttcttttcattcagcagtttggaaacactgttttcataatatctgtgaagggttatctgggagcgcatcgaggcctgtggtgaaaaaggaaatatcttcagataaaaacttgaaagaaacttctgagaaactgctttgtgatgtgtgcattcataacacaaaataaaacctttctttggattcagcagtttggaaacgctgttgttttagaatttgtgatgggttatttttggagctcattgaggccaatggcaaaaaagagaatatcccaggataaaaactaaaaggaagttgtctgaaaaactgctttgttgtgtgtgcattcacctctcagagttaaaatatgcttttcattcagcagtatagaaaaagggtttttgtagaatctgcaaagttatctttgggattgcatggaggcctctgctggaaaaggaaatatcttcacataaaaactaaaaggaagctttccaagaaacgattttgcaatgtgggcattcatctcacagagttaaacacttctgtggattcatcattttgcaaaccctcttgttgtggaatctgcaatgggctattggggagatccttgaggccaaaatggaaaaagtgaatatcccaggataaaaactagacgaaagctacttgagaaaccgtgttgtgatgtgtgcattcattacgcagatttaaacctttcttttcattctgcaccttggaaacactgttttcgtagaatcggtgaagggatttctggaagcgcattgaggcctgcactgaaaaaggaaatatcttcagacaaaaactagaaagaagctttatgggaaattgctttgtgatgtctgtattcatctcacagagttacacttttcatttcattgagcagtttgaaaacactgtttatttcaattgtgtgaatggacatgtgggagctcattgaggccaatggccaaaaagtgaaaatcccatacagcagtttggaaaaactgttctggcagaatccacgaggagatatttggaagtgcattgaggtctatggtgaaaaagaaaatatattcagataaaaactattttgtaggttgcctgttcactctgatggtagtttcttttgctatgcagaagcaatttagtttaattagatcccatttgtcaattctggcttttgttgccattgcttttggtgttttagacatgaagtccttgccaatgcctatgtcctgaatggtgatgccgaggttttcttctagggcttttctggttttaggtctaacgtttaagtctttaatccatcttgaattgatttttgtacaagctgcaaggaagggatccagtttcagctttctacatatgtctagccagttttcccagcaccattgattaaataatgaatcctttccccattgcttgtttttctcaggtttgtcaaagaccagatagttgtaggtatgtggcattatttctgagggctctgttctgttccattgatctatatctctgttttggtaccagtaccatgctgttttggttactgaagccttgtagtatagtttgaagtcaggtagtgtgatgcctccagctttgttcttttggcttaagattgacttggcgatgcaagctcttttgtggttcgatatgaactttaaagtagttttttccaattctgtgaagaaagtcattggtagcttgaaggggatggcattgaatctataagttaccttgggcagtatggccattttcaggatattgattcttcctacccatgagcatggaatgttcttccatttgtttgtatcctcttttatgtcattgagcagtggtttgtagttctccttgaagaggtccttcaagtcccttataagttggattcctaggtattttattctttttgaagcaattgtgaatgggggttcactcatgatttggctctcggtttgtcagttattggtgtataagaatgcttgtgatttttgtacattgattttatatcctgagactttgctgaagttgctaatcagcttaaggagattttgggctgagacgatggggttttctagatatacaatcacgtcacctgcaaacagggacaatttgacttcctcttttcctaattgaataccctttatttccttctcctgcctgattgccctggccagaacttcaaacactatgttgaataggagtggtgagagagggcatccctgtcttgtgccagttttccaagggaatgcttccagtttttgtccattcattatgacattggctgtgtgtttgtcatagacaactcttattattttgagatacgtcctatcaatacctaatttattgagagtttttaccatgaaaggttgttgaatttttgtcaaaggccttttctccaactattgacatagtcatgtagattttgtctttgtttctgtttatatgctgggttacatttactgattttcatatgttgtaccagccttgcatcccagggatgaagctcacttgatcatggtggataagcttttagaagtgctgctggattcggtttgccagtattttattgaggatttttacatcaatgttcatcaaggatattgatctaaaattctctttttttttgttgtgtctctgtcaggctttcgtatcaggatgatgctggcctcataaaatgagttagtcaggattccctctttttccattgtttggagtaatttcagaaggaatggtaccagctcctccttgtacctctggtagaatttggctgtgagtccatctgatcctggactgtttttggttggtaagctactaattattgcctccatttcagagcctgttattggtctatgcagaattcaacttcttcctggtttagtcttgggagggtgtatgtgttgaggaatttatccatttcttctagattttctagtttattttcataagggggtttatagtattctctgatggtagtttgcatttctgtgggattggtggtgatatcccctttatcattttttattgcatctattttattcttctctcttttcttctttattagtcttgctagcggtctatcaattttgttgatctttttaaaaaaacagctgctggattcattcattttttgaagggctttttgtgtctctatttccttcataagaatcaaaaaagagcctgcattgccaagtcaatcctaagccaaaagaacaaagctggagacattactctacctgacttcaaactatactacagggctacagtaaccaaaacagcatggtactaataccaaaacagagatgtagaccaatggagcagaacagaaccctccgaaataatgtctcatatctacaactatctgatctttgacaaaccagacaaaatcaagcaatgaggaaaggtttccctatttaataaatggtgctggtaaaactggctagaaatatgtagaaagctgaaactggatgccttctttacaccttatacagtaattaattcaagatggattaaagacttacatgttagacctaaaaccatcaaaaccctagaagaaaacctaggcaataccgttcaggacatggcatggggaaggacttcatgtctaaaacaccgaaagcaatggcaacagaaaccaaaattgacaaatgggatctaattaaactaaagagcttctgcacagcaaaataaactaccatcagagtgaacaggcaacctacagaatgggagacaatttttgcagtctactcatgtgacaaaggactaatatccataatctacaatgtactcaagcaaatttacaagaaaaaagacaggtaaccccatcaacaagtgggcaaaggttatgaacagacagttctcaagagaagacatttatgcagccaaaagacacatgaaaaaatgctcatcatcactggccatcagagaaatgcaaatcaaagccacaaggagataacttctcataccagatggaacggagatcattaaaaagtcaggaaacaataggtgctggagaggatgtggagaaataggaacacttttacactgttggtgagactgtaaactatttcaaccgttgtggaagtcagtgtggcagttcctcgggaacctaggactagaaataccatttgacccagccatcccattactgggtatatacccaaagtattataaatcatgctgctataaagacacatgcacacgcatgtttattgtggcactattcacaatagcagagacttggaaccaacccaaatgtccaacaatgatacattggatgagcaaaatgtggcacgtatacacaatggaatactacgtagccataaaaagtgttgagttcatgtcctttgtagggacatggatgaagctggaaaccatcattctcagcaaacttttgcaaggagaaaaaacaaaacaccacatgttctcactcattggtgggaagtggacagtgagaacacttggagaaaggaaggggaacatcacatactggggtctctcatagggtaggggaaatgggggagggatagcattacgagatatacctaaggtaaatgacgaattaatgggtgcagcacatcaacacggcacatgtatacatatgtttcaaacctgcacgttgtgcacatgtaccctaaaacttaaagtataataataataaaaagaaaaactaaaataagctatctgaaaagtgctttgtgatgtatgcattcatctcatagagttaaagctttcttttcattcagctgtctgtaaatattgttttggcagaatccgtgtgtcgatgttttggagcgcattgattcctatggtgaaaaaggtaatatcttctgacaaaaactagaaggattgtttctgagaaacttctttgtggtgtgtacattcatctcacagggttaaaattttctttggattcaggagtttggaaacactgttgcagaatctgcgaagggatatttgggagctcattgaggcaaatgatgaaaacacgaatataccaagataaaaaccagaaggaaactatttgagaaactacttggttatgtgtgcattcatcctacagaattaaacttctcttttcatttagcagtatggaaacacttttttcatagaatctgtgaagagatatctgggagcccactgaggcctatggcgaaagaggaaatctcttcggataaaaactagaaagaagctttctgagaaactgttttttgttgtttactttcaccttatagtgttaaacgtttctgtggatttgcaaacactatttttgtccattctgggaatggacatttgtgagcaaattgaggccaatcgagaaaaaacgagcatcacaggatagatagaaactagaaggaagctatctgagcaactgctttgtgatgtgtgcattcacctctaagagataaacttttctttactcagcagtctggaaacaatattttggcagaatacatgaagggatattttggaacacatttaggcctatagggtaaaaggaaatatcttcaggtaaaaactagaaagaagctttctgaaaaactgctttgtgatgtgtgcattcatctcacagagttaaacctttctgtggaaacagccatttgcacacactgtttttgtcccttctatgaatggacatttgggagcacatcgaggcctgtggtgaaaatggaaacatcttgtgataaaatctagaaagaatctttctgagaaactgctttgtgatgtgtgcattcatctcacagagataaacctttcattagattcagcagtttgtaaacactgttattgtagaatctgcaaagggatgtgtgggagatcattgatgccagtggtgaaaaagacaatatcccattataacaactagaaggaatcaatctgagaaaccgctttgggatgtgtgcattcaactcacagagataaacttttcttttcatgcagtagtctgggaacactgttttgacagaatctgcaaagggatatttgggagcacattgaggccaagagtgaaaaaggaaatgtcttcagataaaaaccagaaagaagctttctgagaaactgctctgtgatgcatgcattcatctcacagagttaaacctttctttgcattcagcagtttggaaacactgttgttgtagagtctgtgaagggatatttgggagcttattgaggccaaagtggaaaaacagaatatcccaggaaaaaaacaagacggaagttatctgagaaaccgctttttgatttgcgtattcatctctcagatgtaaaacattcttttcattcagcactttggaagcactgttttcgtagaatctgcgaagttatatttgggaatgcatagaggcctatggtgaaaaaggaaatatcttcagattaaaaataagatttctgataaaatgcttttctatgtgtacatttatctcacagagttaaacctttctatggattcagcaaattgcaaagactctttgtgtccattctgtgaatgggcatatgggaacttattgaggccaatggtgaaaaagtgaatatcccagtataaaatgtggaaggcagctacctgagaaaccgctttgtgatttttgcattcatcttccctaggtaaacttttattttcattcagcagtctggatacaccgttttggcagaatctgtgaagggttatttgagactgcattcaggcctgtggtgaaaaagcaaatatattcagataaaaactagaaagaagttttctgagaaactgctttgtggtgtgtgcatttgtctcaaagagttaaacctttctgtggattcagcagtttggaaacattgttgttgcagaccctgtgaagggatatttgtgagcttaatgatgccaaaggcgagaaagcaaatatctcaggaagaaaactagaaggaagatatctgagaaactgatttgtgatgtgtgcatttacctcgcagagttaaaactttcttttcatagagcagtctggaaacactgttttgacagaatctgcaaagggatatttgggagcacattgaagcctatggtgaaaaaagaaataatatcttcacataaaaaccagaaagaagctttctaagaaactgatttgagatgtgtgcattcatctcacaaagttaaacatttctttggattcagaagtttggaaacactgttctagaatcttcaaagggttattttgaagctcactgaggccaaaggtggaaaagcgaatagcccaagagaaaaactagaaggaagctatctgagaaactgcctcatgatgtgtgcattaatctgacacagttaaaacgtttcttttcattcagcagtttggaaacacggttttcatagaatctgtgaaaggatatctgggagcacatttagtcctatggtgaaaaaggagatatcttcagataaaaccagaagcattctgaaaaactgccttgtgatgtgtgcattcacctcacagagttaaacctttctgtggattcagcagtttgcaaactctgtttttgtccactctgtgattggacgttagctagcccaatgcagcctatggccaaaaagcgaatatcccaggataaaaacaagaaacatgctatctatctgaggaactgttttgtgatgtgtacatcacctcgcagagaaaagcctttcttttcattcagcaacctggaaatactcttttggcggaatccatgaagggaaatttgggagtgtatagaggcctatggtgaaaaaaggaattatcttcagataaaaactagaaagaagctatctgagaaaatgctttgtgatgtgtgcattcatctcaaagagttaaaactttctgtagattcatcagttcacatatactatttttgtccatactgcgattggacatttgggagctcactggggacaatgtccaaaaatggaaaatcccaggataaaaaataaaatgaagctatctgagaaactgctttttgatgtgtacattcacttcacagatttaaacttttcttctcattcagcagtctggaaacactgttttggcagaatccgagaagggatatttgggagcacctagaggcccatggtgaaaaagaaaacatgttcagataaaaactagaaagaagctttcttagaaaatgctttgtgatgtgtgcatttctctcacagagttaaaactttctgtggattcagcagtttagaaacactgtttttttagaagctgggtagggatatttgggagcttaatgaggcaaatgcaaaaaacggatatcccaggataaaaactagaaggaagccctttgagaaaactctttctgttgtgtgcattactcttgcagatttaaacctttctttccattcagcaatttggaaacactgttttcatagtatctgcaaagtgatatcttggagcacttactttgagatctgtggtgaaaaaggaaacatattcagtttaaaattagaaagaagttctatgagaaactactcggtgttttgagcattcatctcacagagttaaacctttctgtggattcagcagtcataaacactgcttttgtctattccatgaatgcacatttggctgctagttggagccaaaggagaaaaagtgaatatcccaagataataactagaaagaagctatctgagaaaccgctttgtggtgtgtgcattcatctcacagagttaaacctttcttttcattcagcagtttggaatcactgtttacgtataatctgtgaacggatatctgggagcacattgtggtctatggtgaaaaaaataccttcaggtaaaaactagaaagaagttttctgaaagaatgctttgtgatgtgtgcattcatctcacagattgatagcttctgtggattcagcaatttgcaaacactgtttttgtccattctgcccatggacatttgggagccctttgtggccaatggaaaaaaagcaaatatcccaggatgaaaactagaaggaagctatatgagaaatcgctttgtgatgtgggaattcacctggcagagataaatttttcctttcattcagcagtatggaaacgctgttttggcagaatcagctaagggatatttgggagtgcaaagaggtcaattgtgaaaaagggaataacttcacataaaaactataaagaagctttctgagaaactgctttgtgatgtgtgcattcatcacacagagttaaatatttctttggattcagcagtttgccaacattgttttggcccattctgtgaatagacatttgggagctcattgaggccaatggcaaaaaaccgaatatcccaggataaaaactaataaaaactacctgagacactgctttatgaatggagcattcacctcacagagttaaaactttcttttcatacagcagtctggaaacactgctttggaagaatccacaaagtgatatgtgggagcacattgaggcctaaggtgaaaaagtaaatatcatcagataaaagctggaaactagctttctgagaaactgctttgtgatgtgtgcattcatctcacagagttaagcctttctttggatttggcattttggaaacactgttgttgtaggatctgcatagcaatatcttggatcttaatgatgacaatggtgaaaaagtgaatatcccaggaaaaaaaaaactagaaactgctttgtgatgtgtgcattcatatctcagagttagaccttgcctttatttagcagtttggaaacaatgtttttgtagaatctgtaaaggtatacctgggagcgcattgaggtccatggtgaaaaatgaaatatcataaaataaatcaataaataagctttctgagaagttgatttgtcatatgtgcattcatctcacagagttaagcttttctatggattcggccatttgttaaaactgtttttctgcattctgtgaaaggacatttgggagttcatagaggccaatggcgaaaaacaaatatcccagaataaaaactagaaggaagctacctgagaaactgctttgtgatgtgtgcattcaggtcacagagttaaaactttgttttcattcaatagtttggaaaaactgttttcgtaaaatatagtaagtgatatctgggaacgcatagaagactatggtgaaaaaggaaatgccttcagataaaaactagaaagaagctttcagaaaaactgctttgtgatgtgtgcattcatctcacagagttaaacctttctatggattcagcaatttggaaatacttttgttgaagaatctgtgaagggatatattggaacttaatgaggtcaatggcaaaaaagcaaatatcccaggaaaaaaactagctggaagctatctgagacactgctttgtgatgtgtgcattcacctctcagagataaacctttcttttcattcagcagtttggaaacactgtttttgtagaatcttcgaagtgatatcttggagtgcattgaggcctaaggtgagaaaggaactatcttcagataaaaactagaaagaagctttatgagaaattgctttgtgatgaatgaattcttctcacagtgttaaaactttctgtggattcagcagtttgcaaacactatttttgtccattctgcaaatggacatttggaaactcattaaggccaatgatgaaactgcaaatatcctaggataaaaactagaaaagagctatctgagaaccggctttctgaggtgtgctttcacctaggagagttaaaactttcctttaatacagcattctggaaacactgttttggcagaatctgtgaagggatattttggagggcattgaggcttatggtggaaaaggaaatatcttcagaaaaaaactagaaagaaactttctgagacgctgctttgtgatgtgtgcattcagcttatagagttaaaccttcctttggattcatcagtttgataacactgttcttgtagaatctgggaagaaatatttgggagcttaattaagcaaaatgctttgagaaagtgaatatcccacgataaaaaccagagagaagcttaatgagaaacttgcttgggatgtgtgcattcatctcagacagtaagactttccttggttgcagcagtttggaaacattgttttaaccattctggaactggacatttgtgggcttattgaggccaacggtaaacaaagcaaatatcccaggataaaaaccagaaggaaaaatctgagaaacagttttgttatgtgtgcatcaatctagcagagttaaacatttcttttctttcagcagtttggaaacactgtttttgtagaatatgcaaagagatatttggttgtgcattgaggcctatggtgaaaaaagaaatatcttcagaaaaaaattagaagctttctgagaaactgctttgtgatgtgtgcattcatctcacagacttaaacattttttttgattcagcagtttggtaacactgtttttgtagaatacaaaaagggatattttggagctcattgaggccaaaagcaaaaaagtgaatatttcaggataaaaactagaaggaagctatctgagaaactgtcttgttatgtgtgcatccatctcacagatttaaacgtttcttttcattcagcagtttggaaacacattttagtacaatcatctgtgaaggggtatgtggaggtgcattgaagcttatggcgaaaaaggaaatatcttcagataaaaaccagaaagaagctttctgagaaactgctcggtgatgtgtgctttcatgtcacagatttaaacctttctttggattcagcattttggaaacatttggacaatttgcagctcattgatgacagtggtgaaaaagtgaatatcccaggataaaaactcaaaggaagctagctgagtaactgctctatgatgtgtgcattcgtctcacagagttaaaccttcctttcaattcagcagtttgaaaacactgttttcatagatactgcgaagggatttcgggggccgcattgaggcctatggtgaaaaagaaaatatcttcagttaaaaagtagaaagaagcattctgagaaactgctttgagatgtgtgccttcatctcacagacttaaatgtttctttggattcaatagtatggaagcactgtttttgtcgaatctgtgaagaggtagttgggagtgcattgaggccaaaggtgaaaaagcaaatatcctgggataaaaactagaaggaagctacctgagaaatccctgggttatgtgtgcattcatcttgcagagttaaacctttccttttattcagcagtaaggaaacactgtttttgtagagtctgcaaagggacatttaggagctcattgaggccaaatgcgaaaaagtgaacagcctgggataaaaactagaaggaagatatatgtgaaaccacttagttatgtgtgcattcatctcacagagttaaacctttcttttcattcagcagtttggaaacactgttttggtggaatctgtgatgggatattttagagtgcattgaggcctatggtgaaaaaggatctatctttagataaaaactagaaaaaagcattcagagaaacttctttgtaatgtgtgcattcatctcacagagttaaacctttcttctgattcatcattttggagacactgtttttgtccctttcgcagaatggacaattgggagaccattgaaaccaatggtgaaaaagtgaacatcacaggataagaagtagaagaaagatatctgacaaaccgctttgggatgtgtgcattcatctctcagagttaacttgtttttcattcagcagtttggaaacactgtttttgtagaatctgtgaagggatatttgggagctcattggggccaaaggtgaaaaagtaaatatcccacgataaaagctagaataagctatctaagaatatgctttgtgatgtgtgcattcatctgacagagttaaatgtttcttttcattcagtagttttaaacacattttggtagaatctgcaaaatgatatatgggggtgcattgaagcctatggtggaaaaggaaatatcttcatataaatactagaaagaagccttctgacaaattgctttgtgatgtgtgctttcatgtcacagagttaaacatgtctttggatacagcatttgggaaacactgtttctgtccattctatgaatggacatttggcagctcattgaggccaatggtgaaaaagtgaatatctcaggataaaaacttgaaagaacctgtctgagtaaccacattgtgatttgtgcattcatctcacagagttaaaccttcgttttcattcagcagttttgaaacactgtttttgtagaatctgcaaagggatattggggcacgcattcatgcctatgttgaaaaagaaattattttcagtaaaaaactagaaagaatctttctgagaaactgctttgtgatgtggacattcatcacacagagttaaacatttctttggattcagcagtatggaaacactgtttttgtagaatttgcaaaggggtatttaggagctcattgaagccaaaggcaaaaaaggaaatatcccaggataaaaactagaaggaaactatctgagaagccacttggttatatgtgcattcacttcacagagttaagctttcttttaattcagcagtttggaaacactactttgtaaaatctgcgaaggggtttttgggagaccattgaggcctatggtgaaaaatgaaatatgttcagataaaaactagaaagaagctttctgagaaactgctttgagatgtgtgcattcatcacacagagttaaacctttctttggattcagcagtttagaaaccatgtttttgtccattctgtcaatggacatttgggagctcattgaagccaatggcaaaaaaacaaatatccctggataaaaactagaaggaaactatctgaggccgctttgttatgtgtgcattcatctcacagagttaaacctttattttcatttggcagtttggaaacactgtattttaaaatctgtgaatggatatatgggaatgctttgagtcctatagtgaaaaaggaactatcttcagatgcaaactagaaagaagttttctgagaaacagctttgttatgtgtgcattccactcacagagttaaaaccttttttgtattcacaagtttggaaacattgtttttgtagaatctgcaaaggaatatttgggaggtcattgaggccaaaggcaaagagtgaatattctagcataaaaacagaaggaaactatcggagaagcctctctgagatgtgtgtcttgatctccaaaagttaaaatttttttaacattcagcagtttggaaacacagttttgtaggatctgcaaagttatattttgttgtgcattgtggactatggtgaaaaagaaatatcctcagctaaaaattacaaagaaggtttctgacaaactgctttggaaagatgcattcatctcacatctcacagagatatacacattacttttgattctgcagtttgaaaacactgtttttgttctttctgcaaatggacatttgggagctcattgaggacaatggcaaaaacgcgaatatcccaggataaaaactagaagggagttgtctgaaatactcgctttttcacctttggcctgaatgagctcccaaatatccattcacagaatggacaaaaacagtgtttcccaactgatgaagcaaaagaaatgtttatctctatgagatgaatgcacacatcagaaagcaattcctcagaaagattatttctactttttatctgaaaatatttccttttaccatagccctaaaaatgatttgaaatttctctttgcatattctatgaaaacagtgtttccacaatgctgaatgaaaagaaaggtttaactctgctagatgaatggatacatcacaaagcggtatctcagatagcttccttctagtttttatcctggggtattcacttttttgtctatggcctcaatgagctatcaaatatcccttggcagattctactaaaacagtgtttacaaactgttgaatccaaggaaatgttgaaatctgtgagatgaatgcacacatcacaaagccgtttctcagaaagattccttctagttttgatctgaagttatttcctttttcaccataggccacaaagccctcctatatatagcttcacagagtctaccaaaacagtggttccaaactgctgaatgaaaagaatgttttaactctgcgaaatgaatgcatccatcacaaagtggtttctcaagtagtttctttctagtttttatactgggatattcgctttttcccagatggcctctatgagctgccaaatatccctttgcacattctacaataacagtgtttccaaactggtgaatccaaagaaaggttttactgtgtgatatgaatgcacacatcataaagcagtttctcagaaatcttctctctagttttcaacagaagatatttcctttttaccataagcctaaatgcgctcccaaatatccctttgcagtttctacaaaaagagtgtttccaacctgttgaatgaaaataaaggtttaactctgtgagatgaatgcacatatcacaaagtggtttttcagatagattctttctaatttttttcatgggatattcactttttggcctttggcttcaatgagctgtctaatatcccttcgcggattctacaaaaagattgcttgaaaactgctgaatccaaaaaacggtttaacactgttaggtgaatgcacacatcataaagcagtttctcataaagcttcttcctactttttgtctgaagatatttcctttttcaccataagcctccgtgctctcccaaatatccctttacagattctaccaaaacggtgtttccaaactgttgaatgaaaagaaaggtttaactctgtgatttgaatgcacccatcacaaagcagtttctcagatagctttcttctaagttttatccttggatattcactttttctccttggcctcaatgatctcccaaatgtccattcatagaacggacaaaaacagtgtttctacactgctgaatccaaagaacggttcaactcttagagatgaatgcacacatcacaaagcactttctcgtaaatcttctatcttgtttttttctgaagatatttcctttatcaccatagtcctctatgtaattccaaatgttccttcacggattctgccaaagtagtgtttccaaactactgtatgaaaagaaagttttaactcttccaggtgaatgcacatcacaaagtggtttctcagatagcttccttctagtttttctcctgtgatattcactttttcaccattgttgttaatgaactatcaaatgtccttttgcagaatgggtgaaaacagtgtttgcaaaatgctgatttcactgaaaggattatctctgtgagctgaatgaacacatcacaaagcagtttctcagagagcttctttctagattttatctgagtatatttcctttttcaccatgggcctcaatgcccttccagatatccctttgaagtttctatgaaaacagtgtttccacaatgctgaatgaaaagaaagtttaacactgtgagatgaatgcacacatcacaaagtggtttctcagatagctttcttctagtttttattctgggatattcgctttttcacctttgaactcaatgacctccaaagtgtccattcgcagaatggacaaaaagagtgtttccaaactgctgaatccaaagaaaggtttacctctgtgagatgaatgcacacatcacaaagcagtttttctgaaagcttctttctagttcttacctgaaagtattttctttttcaccataggcctcattgcattctcaaacatccctttgtggattctgccagtacagtatgccaaactactgtatgaaaagaaaatattaactctgtaaggtgaatgcacacatcacaaaggtttttctcagatagcttctttgtagtttttatccttggatattcactttttcacctttggactaaatgagctcccaaatttccattagcagaagggacaaaaacagtgttttcaaactgctgaatccaaagaaaagttgaaatctgttagatgaatgtacacatcacagagcagtttttcagaaagcttctttctagttttatctgaagctatttcctttttcaccgtaggcctcaaagcactccaagttatccttttgcagattctacgataacagtgtttccaacctgctgaaaaaaagaaatgtttaactctgtgaaatgaatgcacacatcacaaagtggtttttcagattgctttcttctatttttttctagtatattttctttttcgtcattggcctaaatgagctcctgaatatccgtttgtatattctaaattaacagtgttttcaaactgctgaatcaaaagtttactctatgagatgaatgcacacatcacagagcagtttctgagaaagcttctttctaattttcatttgaacatatttcctttttgaacataggcctcaatgagctcccaaatataacttcacagaaactgccaacacagtgtttccagactgctgagtgaaaagaactttttatctcagcgaggtgaatgcacacttaagaaagcgatttctcaaatagcattcttctagtttttatctggggatattcactttttcatcattggcctcaatgagctccccaatgtacatttgcagaatggacaaaaacagtatttgcaatctgctgaatccacagacagttttaacacagtgagatgaatgcacaaatcacaaagcagtttctcagaaagcttctttccacttttaatctgaagatatttcctttttcaccataggcctcaatgcactcccagataccacttcgcagattctacgaaaacagtgtttccaaactgctgaatgaaaagaaaggtttaactctgtgagaggaatgcacacatcacaaagtggtttctcaaatagcttccttctagtttttatcctgggatagttggtttttccccttttgcttaatttagctcccaaatttcccttcacagattctacaatgacaatgtttccaaaccgctgaatccaaagaaaggtttaactctgtgaggtgaatgcacacatctcaaagctgtttctcagaaacttcctttaatttttatctgaagactttttaccacagaccccaaatatcccttcgtgaattcttccaaaacagtgtttacagattgcagaatgaaaagacagttttaactctttgaggtgaatgcacacatcacaaagtagtagctcagatagctttcttcccatttttatcctgggatattggcttccttgtcattggtctcaaggagctcccaaatatccgtttgcagattctacaacaacggggttttcaaactgctgaatctaaagaaaggtttcattctgtgagatgaatgcgcacatcacaaagcagtttctgtgaaagcttctttgtggtttctatcagaagatatttcctttttcactgtaggcctcaaatgcactccagatatcccttcacactttctacaaaaacagtgtttccaaattgctgaatgacaagaaatgtttaactctgtgagactaatgaacacatcaccaagaggtttctcagattaatttcttctagtttttttttcctggaatatttgcatttccgccattggcctcagtgagctcccaaatatccctttgcagaatctacaacaacagttttttccaactgatgaatccaaagagaggtttaacactgtgagatgaatgcacacatcacagagccgtttctcagagagtttctttcttttatctgaagatagttcctttacaccataggcctcagtgagctccaaaacatccctttggggattctgccaaaacagtttttccagactgctaagtgaaaagaaagttttatccatacaatgtgaatgcacacatcacaaagcagtttctcagattgatttcttctagtttttgtcctaggatattcactttttctccattggcctcaatgagctctcaagtatcccttcacagattctacaacaacgatgcttccaaactgctgaatccaaaggaaggtttaactctgtgagatgaatgcacaaatcacaaagaagtttctgagaaaacttccttttaatttttatctgaaaatatttcctttttcatcataggcctataggtgctcccaaatatcccttcatggataccgccaaaacagtgtttccagactgctaaatgaaaagcaacgtttatctctgcgaggtgaatgtcacatcacaaaactgtttctcagatagtttctttctagtttttatcctgggatattcccttttttgccattggcctcaatgagctcccaaatgtccatacgcagaatggacaacaacagagttttcaaactgctgtatccaaagtaaggtttaactctgtgagatgaatgcacacatgtgaaagtagtttctcagaaagcttctttgtagtttttatctgaggttatttcgtttttcaccataggcctcaatgcactcctagatatcactttgcagattctacaaaaatattgtttccaaactgctgaatgaaaataaaggtttaactctgcgagttgaatcctcacttcacaaagcagtttctcagaaagtttctttcttgtttttgtttgaaaatatgtcctttatctccatcagcctctatgcgttcccaaataacccttcggggattctgccaaaacagtgtttccagactgctaaatgaaaaacaatgtttatctctgcatggtgaatgcacacatcaccatgcgatttctcagatagcttccttccagtttttatcctgggatattccctttttcaccactggactcaatgatctctcagatatctatttgaagaatggtcaaaaacagtgtctgcaaactgcagaatccacagaaaattttaactctgtgacatgtaagcactcatcacaaagctgtttctcagaaagcttctctctagtttttatctgaagatttctttttcaccctggcctcaatgcgctcccaaatatcccttcatggattctgccaaaaacagtttttccagactgctggatgcaaagaaagttttaactcttccaacggaattcacacttcacaaagcagtatcttagattgcttccttgaactttttatcaagatatggcctttttcaccacaggcctcaaggtgctcccaaatatccctttgctgattctgccaaaacagtgtttccagattgctgaatctaaggaaatatttatctctgtgagatgaatgcacacatcacaaagctgtttctcaaatagctttccttgagattttatgatgggatattccctttttttgccatttatctgaaagaattcccaaatgtccatttgcagaatggacaaaaacagtgtttgcaaactactgaatccacagaaaatttgaaatctttgagatgagtgcacacatcacaatatagtttctcagaaagctttctgaaaatctgaaaaaaaaatctgaagatatttgtttcactgtaggcctcaaagggctcccagatattcctttgcagattctacaaaaacagtgtttccaaagtcctgaatgaaaagaaaggtttaattctgctagatgaatgcacacatcacaaagcagtttctcaaagagcttccctgtagtttttatcctgggatattcgtgtttttgccattggcctcaatgaacttcaaaatatccattttcagaatggacaaaaacagtgtttgcaaactgcttaattgataggaaagttgaactttgtgagatgaatgcacacatcacaaagcagtttctcagaaagattctttgtagtttttatctgaagatattccctttttcaccgtaggcctctatgcactccaatatagacctttgcagattgaagaaaaacaatgtttcccaacttctgagtgaaaagaatgttttaattctgatagaagaatgcacacatcacagggcggtttctcagacagcttccttctaatttttattctgggaaggtccatttttcccctttggcctcactaagctcccaaatttccctacacagattctaaaacaacagtgttttcaaactgctgaatggaaagtaaggtttaactctgtgagatgaatgcacacatcataaagcatttctccgaaagatcctttctaatttttatctgaagatatttccttttcaccataggcctcagtgtgctcccaaatatccctttgtggattctgccaaaacagtttttccagactgctaaatgaaaagaaagttttaaatgtgtgaggtgaacacgaacatcacaaatcagtttctcaggtagcttccttctagtgtttatcctgggatagtttttttccccctttggcctcattaagctcccaaatatcccttcacagattacacaacaatgctgtttcaaaactgctgaatccatagaaaattttaactctgtgaggtgaatgcacacatcacaaagctttttctcagaaagcatctttctagtttttatccaaagattttttttttcaccatagccctcaaagcactcccaaatatcccttggcaagttctggcaaaacagtgtttacagattgctgaatgaaaataaagttttaactcatagcttccttcaagtttttatcacgggatgttggctttttcgatattggcctgaatgaactcccaaatatccctttgcagattctacaacaacagggttttcaaactgctgaatccaaagaaagatttaactttatgagatgaatacacacaacataaaatagtttctcaggaagtttatttctagtttttatctgaagttatttcctttttcaccataggcctcaatgtgatccctgatatcccttcacagattctatgaaaacagtgtttccaaattactgaatgaaaagaaaggtttaactctgtgagatgaatgcacacaccacaacgtagtttctcagattgatttcttctagttttttttttcctgggatatttgatttttcaccattggccccaatgagctcccaaatatcccttcacagattctacaacaacagtgttttcaaactgctgaatacaaagaaaggtttacttctgtgagatgaatgcacacatcccacagcagtttctcagatagcttctttctatttgttatctgaagatatttccttttcaccacagatctcagtacacacccatatattcctacgcggactctgtcaaaacagtttttccagactcctaaatgaaaagaaagttttatctctatgaggtgaatgcacacatcacaaagaagtttctcagatagcttccttctctattttatcctgggatattcacttttttgcctttggcttcaatgagctccaaaatatcccttcgctgattctacaacaacagtgtttctaaactgctgaatccaaagaaaggtttaactctgtgagatgaatgcccgaatctcaaggtagtttctgagaaagctgttttctagttttcatctgaggttatttcctttttaccataggcctctaagggctccaatatatatctttgcagattctacaaaaacaatgtttccaaactgctgaatgaaaaggacttttcaccactgagaggtgaatgcacacatcacaaagctgtttctcagatagcttctttctagtttttattctgggatagtccatttttccctttggcctacttatgctcccaaattttccttcatggatactaaggcaacagtgtttacaaactgctgtatccaaagaaaggttgaactctgtgagatgaatgcacacatctcaaggcagtttctcagaaagattctttctaggttttatctgatgttatttcctttttcaccataagcctcaatgcactcccagatatcacttcacagattctctgaaaacagtgtttcaaaactgctgaatgaaaagaaagctttaactctgcgaggtgaatgcacacatcacaaggcagtttctcagaaatcttctttgtagtttttacctgaagatatttcctttttcatcataggcctcaaggcactcccaaatatcccttcatggattctgccaaaactgtgtttctggactgctgaaggaaaagaaaggtttgtctctgcgagatgaatgcacacttcacaaagcagtttctcaaatagcttcccactagatttttccttggatatttgctttttcaccattgatctgaaagaactccaaaaagtccattcacagaactgacaaaaacagtgattgcaaccaactgaatccacagaaagtttgaacactgtgagatgaatgcacacatgacaatgcagtttctcagaaggcttctttctagtttttatctgaagatatttcctttttcaccataggcctcaatgtgttcccagatatccctctgcagaatctatgaaaacattgtttccaaatttctgaatgaaaataaaaatttaactctgtgaaatgaatacacacaacacaaagcagtttctcaaatagcttccctttattttttacccttagatatatgcatgtttgccattgtcctcaatgagcttcaaaatgtccattttaagaatggacaaaaacagtgtttgcaaactgcttaatccaaggaaaggttgaactctgttagatgaatgtacacaccacaaagcagtttctcagaaagcttctttgtagtttttatctgaaaatatttcctttttcaccatagtcctctatgcactgcaaaatataccttcaaagattctacaaaaagagtgattccaaactcttgaataaaaagaatgctttaaatcttagacatgaatgcacacatcacaaagcagtttctcagatagtttccttctagtttttatcctgggatatttgcttttttgctattggcctcaaggaaatcccaaatgtccattcgcagaaaggaccaaaacagtttccaaactgctgtattgaaaaaaaaggtttaactctgtgagatgaataaacgcatcacaaagtagtttatcagaaagaatcttgctcagttttatctaaagatatttcctttttcaccataggcctcaatgcactgccaaatatcatttcacagtttctacaaaaacagtgtttccaaactgctgaatgaaaataaaggtttaactttgtgcagtgaatgcacacatcacaaatcggtctctcagacagcttccttctagtttttatcctgggatattagcattttcacctttggcctcaatgaactccaaattgtccatttgcagaatgcacaaaaaaagtgttttcaagctgctgaattcaaagaaaggtttaactctctgagatgaatgaacacatcacaaagcagtttctcagaaagcttctttttaattgttatttatagataattccttttttaccatatgcctcaaagcactaccaaatatccattcatagtttctacaacaacagtgtttccacactgctgagtaaaaagaaaggtttaactcagctaggtgaatgtaaacttcacaaagcagagtctcagacagcttccttctagtttttatcccgggatattcactttttcaccattcacctcattgagctcccagatgtccattcacggaatggacacaaagtgtgttaacacactgctgaatctaaagaagggtttaactctctgagataaatgcacacattccaaaccagtctctcattaagcttccttctattttttatttgaagatatttccttttttaccatagacctccatactcttccaaatatttcttcgcagattctaggaaaacagtgtatccaaattgctaaatgaatagaaagttttaactctgtgcaatgaatgcacacatcacaaataggtttctcagataacttccttctagtttttgtcctgggatattcgctttttctccattggcatcaatgagctcccaaatgtccattcacaaaatggacaaaaacattgattccaaactgcggaatccagagaaacttttaactctgtgagatgaatgaacacatcacaaatcagtttctcagaaagcttctttctagtttttatctgaagatatttcctttttcaccataggcctcaaagtgctgcagaatatcctttcacagcatctgttaaaacagtgtttccaaattgctgaatgaaaagaaaggtttagctctgcgagatgaatgcagacatcataaagtggtttttcagagagattccttcagtttttaccctgggatattcgctttttcaccattggcctcaataagctctgaaatatcctatgctgaatggacaaaaaccgtattaccaaactgcagaatccaaagaaagctttaactctgtgagatgaatgcacacatcacaaagcaatttctcattaagcttctttctagtttttatctgaagatatatcctattctccatagtcctcaatgcgctaccaaatatccctttgtagattctaagaaaacaacgtttccaaactgctgaatgaaaagaaaggtttaaatctgtgagctgaatgcacacattacaaagtggtttctcacagagcttccttctagtttttatcctgggatatttgccttttcacctttggcctcaatgagttcccaaatgtctacttgcagaatggacaaaaacagtgataccaaactgctgaatcctaaaaaatgttttactctgtgggacgaatgaacacataacaaaccaatttttcagtaaacttcttgatagtttttatctaaggatatttctttttacaccataggcctcaatgtgctgccaaatatcctttcacagtttctacaaaagcagtgtttcccaactgctgaatgaaaagaagggtttaactctgtgagatgaatgcacacatcacaaagtggtttctcagagagcttccttctagtttttatcctggcatattcccttttttgccattggcctcattgagctcccaaatgtccattcacagaattgtcaaaagcattgttatcaaactactgaatccaaagaaaggtttagctctgtgagatgagcacacacatcccaaacaagtttctcattaaacttctttccagtttttttctgaagatatttcctttttcagcataggcttccatactcttccaaatatcttgtcagagattataagaaaagagtgtttgcaaactgctgaatgaaaagaaagttttacctctgtgagatgaatacacacatcagaaatcagtttctccaataagttccttccaatttttatcctgggatattcactttttcaccattggcctctatgagctcccaaatgtccattcgcaaaatggacaaagagtgattttccaaactgctgaatccaaatgaaggtttaactctgtgagatacatgcacacatcccaaaagcagtttctcattaagcttctttgtagtttttatttgaagatatttcctaatcaccataatcctcaatgtgctatcaagtattccttcaaagattctaagaaaatagtgtttccaagctgctgtatgaaaagaaaggtttaactctgtgagatgaatgcacacatcacaaatcactttctcagataacttccttctagcttttatcctgtgataatcactttttctccattggcctcaatgagatcctaaatatccctttgcagatatttttggtggcgcattgaagcctacagtgtaaaatgaaatatcttcagataaaaactagaaagaagcttaatgtggagctgccttgagatgtgagcattcatctcacagagttaaattttctttggatacagcagtatggtaacattgtttttttccattctgcgaatggacatttcagagctaattgaggacaatggtaaaaaagtgaatatcccaggataaaaactagaaggaagcaatctgagaaactgctttgtgatgtgtgcaatcacctcactgagagaaactttccttttcattcagtagtctggaaacactgttttggcagaatccatgaggggaaattttggagcaccttggggcttatggtgaaaaaggaaatatcttcccataaaagctagaaagaatctttctgagaaactgctttgtgatgtgcgcattcatctcacagagttaaacttttctttggatttaacaatttggaaacactgttgtagaatctgtgaaggggtatttgggagcttaatgaggccaaagatgaaaaactgaatatcccaggaaaaaaatggaagctatctgagaaaccgctgtgtgatgtgtgcattcatctctcacatttataacaacattcagcagtttgtaaacactgtttttatagaatctgagaagtgatatctgagagtgcattgaggcctacggtgaaaatggatatatcttcaggtaaaaagtacaaagaagctttttgtaaaatgctttttgaagtgggcattcaactcacagagttcaaattttctgtgtattcggtagtttgcaaacactgtttttgtccattctgtgaatggatatttgagaggtcaatggtgaaaagaaaacatccctggacaaaaactagaaggaagttatctcagaaaccactttgtgatatgtgtattgaactctcagaattaaaccttttttttctttcagcagtttggaaacactgttttcatagaatctatgaagttatatctgggagtgcattgaggcctatggtgaaaaaggaaataacttcagataaaaattagaaagaagctttctgtgaaactgctctgtgatgtgtgtcttcaccttacggaggtaatcatttctgtggattcagccacttgcaaacactgtttttgtccattctgcaaatggacatttgggagctctttgatgccaatgctgaaaaaatgaatatcccaggatacaaattagaaggaagctattgcagaaactgctttatgatgtgtgcattcacttcatagtgttaaaactttcttttcattcagctgtctggaaacactgttttggcaaatccatgaagggacatttgggagtgcattgaggtcaatggtgaaaaaacgaatatcccaggataaaaactagaaggaagctatctgtgaaactgcttagttctgggtgcaatcattgtgcagatttaaaactttctttccattcagcagtttggaaaaactttttgtagaatctgcaaagggatatttgggcatgcaatgaggcctatagtgaaaaaggaaatatatcttcagattaaaattaaaaagaacttttctgagaaactacttggtgatctgtgcattcatatcacagagttcaacctttctttggattcagcagtttggaaactgtttttgtagaatctgcaaagagacatttgggaattcattgagaccaaaggcaaaaaagtgaaaagtccaggacaaaaactagaaggaattatatgtgaaaccactttgtgatgtgtgctttcatctcttagagataaacctgtcttttcattcagcagtttggaagcactattttggtagaaactgtgatgggatatttcagagtgcaatgaggcctctggtgaaaaaggaaatatctttagatgaaaactataaagaagatttccgagaaacagctttgtgatgtgagcatacctctcagagagtaaaacatttccttgcatttaccagattggaaccactggttttgtagaatctgggaagggatatttgggaggccattgaagccaaaggtgagaaaacaaatattctagcatagaaacaggaagaaagctatcagataaacttctgtgtgatgtgtgccttgatctcccaaagttaaacctttcttttcattgagcagtttgggaacactgtttctgtaggggctgcaaacttatattttgttgctcgttggggcctagggtgaaaaagaaatatcttcagataaaaactacaaagaagctttctgagaaactgcttggtgaaatgtgcattcatctcacagagatacacgtttctttggattcagcagtttggaaacactgtttttgtccattctgtgtatggacatttgggagctcattgaggacaatggccagaaaatgaatatcccaggataaaaaccagaaggaagctatctgagaaactgccttgtgatgtgtgctttcatctcatagacttaatactatcttctcattcaggagtttggaaacactgtttttgtagaatctgcaaagggatatttggaagctcatttgtgccaaaggtgaaaaagcaaatatcccaggataaaaactagaataagctatgtgagaaagtgctttgggatgtgtgcattcatctcacagagataaacttcttttcattcagatagcattctgctagttctaattcttagaatacttgctttttttgcctttggcctgaatgagctcccaaatgtccatatgcagaatggagaaaaacaatgtttcccaactgatgaatcaaaagaaatatttatctttttgagatgaatgcacacataacaaagaagtttctcagaaagatttttttccagtttttacctgatgatatttccttgaccatagtcctaaaagagctgtcaaatttctcttctcatattctaggaaaacagtgtttccacaatggtgaatgaaaagaaaggtttaactctgcaagatgaatggatacatccaaagtggtttctcagataccttccttctagtttgtgtcttgggatatttcctttttcacccatggcctcaatgagctatcaaatatccccatgcagattctactaaaactctgtttacaaactgttgaatctaaagaaatgttgaaatctgtgagatgaatgcacacatcacaaagcagtttctcagaaatcttctttctagttttgatttgaagttatttctttttcaccataggcctcaaggcactccaatgtatacttttgcagattctaccaaaacagtgtttccaaactgctgaatgaaaagaaagttttaactcctctgtgagatgaatgcacacatcacaaagcggtttctcagatagtctgcttctagtttttatcctggaaaattcactttttctccgatgggctcaatgagctccaaaatatgccttcacacattctacaacaacagtgtttccaaattgttgaatccaaacaaagttttaacactgtgagatgaatgcgcacatcacaaaaaagtttctcagaaagcttgtttgtagttttcaactgaagatatttcctttttaccataagcctcattgtgctctcaaatattcctttgcagtttctatgaaaacagtgtttccaacctgctgaatgaaaataaaggtttaactctgcaagatgaatgcacacatcacaaagtggtttttcagatagcttccttctagtttttatcctgggatattcactttttccccattggcctcaatgagctgccaaatgtccatttgcagagtggagaaaaacagtgtttcaaaactactgaatccaaagaaaggtttaactctcttagatgaatgcgcatgtcacaaagcagttgctcagaaatcaccatagttctcaatgcactcccaaatatcacttcacagattctaccaaaatagtgtttccacgctgctgaactgaaaggaaggtttaactctgtgagatgactgcacgcatcacaaagaggtttatcagatagcttccttcttgtttttatcctgggatatttgccttttcagttatggcctcaatgagctatctaatatcctttctcagattctacaaaaatagtgtttccaacctgctgaatccaaagaaaggtttaactctgtgagataattgcacacatcacaaagcattttctcaaaaagcttctttctgctttttacctgaagatatatactttttcaaggatattggtctaaaattctcttttttggttctgtctctgcccggctttggtatcagaatgatgctggcctcataaaatgagttagggaggattccctctttttctattgattggaatagtttcagaaggaatggtaccagcccctccttgtacctctgctagaattcggctgtgaatccatctggtcctggactctttttggttggtaagctattgagtattgccacaatttcagatcctgttattggtctattcagagattcaacttcttcctggtttagtcttgggagggtgtatgtgtcgaggaatttatccatttcttctagattttctagtttattagcatagaggtgtttgtagtattctctgatggtagtttgtatttctgtgggatcggtggtgatatcccctttatcatttttcattgcgtctatttgattcttctgtctttttttctttattagtcttgctagcggtctattttgttgattctttcaaaaaaagagctcctggattcattaattttttgaagggttttttgtgcctctatttccttcagttctgctttgattttacttatttcttgccttctgctagcttttcaatgtgtttgctcttgcttttctagttcttttaattgtgatgttagggtgtcaattttggatctttcctgctttctcttgtgggcatttagtgctataaatttctctctacacactgctttgaatgcatcccagagattctggtatgttgtgtctttgttctcattggtttcaaagaacatctttatttctgccttcatttcgttctgtacccagtagtcattcaggagcaggttgttcagtttccatgtagttgagtggttttgagtgagattcttaatcctgagttctagtttgattgcactgtggtctggagtgagtttgttatactttctgttcttttacatttgctgaggagagctttacttccaagtatgtggtcaattttggaataggtgtggtgtggtgctgaaaaaaatgtatattgtgttgatttggggtggagagttctgtagatgtctattaggtctctttggtgcagagctgagttcaattcctgtgtatccttgttgactttctgtccattgatctgtctaatgttcacagtggggtgttaaaatctcccattattaatttgtgggagtctatgtctctttgtaggtcactcaggacttgctttatgaatcttggtgctcctttattgggtgcatatatatttagtatggttagctcttcctgttgaattgatttctttaccattatgtaatggccttctttgtctcttttgatctttgttggtttaaagtctgttttatcagagactaggattgcaacccctgcctttttttgttttccattggcttggtagatctccctccatccttttattttgagcctatgtgtgtctctgcacgtgagatgggtttcctgaatacagaacactgatggccaaaaatcctcaataaaatactggcaaaacgaatccagcagcacatcaaaaagcttatccaccatgatcaagtgggcttcatccctgggatgcaaggctggttcaatatacgcaaatcaataaatgtaatctgacatataaacagagccaaagacaaaaaccacatgattatctcaatagttgcagaaaaggccattgacaaaattcaacaaccttcatgctaaaaactctcaataaattaggtattgatgggacgtatttcaaaataataagagctatctatgacaaacccacagccaatattatactgaatgggcaaaaactggaagcattccctttgaaaactggcacaaaacagggatgacctctctcaccactcctattcaacacagagttggaatttctggccagggcaatcaggcaggagaaggaaataaagggtattcaattaggaaaagaggaagtcaaattgtcccagtttgcagatgacatgattgtatatctagaaaacctcattgtctcagcccaaaatctccttaagctgataagcaacttcaacaatgtctcaggatacaaaatcaatgtacaaaaatcacaagtatccttatacaccagcaacagacaaacagagagccaaatcatgagtgaactcccattcacaattgcttcaaagagaagaaaatacctaggaatccaacttacaagggaagtgaaggacctcttcaaggagaactacaatccactgctcaaggaaataaaagaggatacaaacaaatggaagaacattccatgctcatgggtaggaagaatcaatatcatgaaaatggccatactgcccaaggtaatttatagattcaatgccatcaccatcaagctaccaatgactttcttcacagaattgggaaaaactacttgaaagttcatatggaaccaaaaaggagcctgcatcgccaaatcaatcctaagccaaaagaacaaagctggaggcatcactctacctgacttcaaactatactacaaggctacagtaaccaaaacagcatggtacttgtaccaaaacagagatatagatcaatggaacagaacagagccctcagaaataatgccgcatatctacaactatctgatctttgacaaacctgagaaaaacaagcaatggggaaaggattccctatttaatcaatggtgctgggacaactggctggccatatgtagaaaggtgaaactggatttcttccttacaccttatacaaatatcaattcaagatggattaaagccttaaacgttagaactaaaaccataaaaaccctggaagaaaacctaggcattgccattcaggacataggcatggacaaggacttcatgtctaaaacgccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaacaccatcaaaaagtgggtgaagtacatgaacagacacttctcaaaagaagacatttatgcagccaaaaaaacacatgagagaatgttcatcatcactggccgtcagagaaatggaaattaaaaccacaatgaggtaccatctcacaccagttagaatggcaatcattaaaaagtcaggaaacaacaggtgctggagaggatgtggagaaataggaacacttttacactgttgggattgtaaactagttcaaccattgtggaagtcagtgtggcgattcctcagggatctagaactagaaataccatttaacccagccatcccattacttggtatatacccaaaggactataagtcatgctgctgtaaagacacatgcacacgtatatttattgcggcattattcacaagagcaaagacttggaaccaacccaaatgtccaacaatgatagactggattaagaaaatgtggcccatatacaccatggaatactatgcagcgataaaaaatgatgagttcatgtcctttgtagggacatggatgaaattggaaatcatcattctcagtaaactatcacaaggacaaaaaaccaaacactgcaaattctcactcataggtgggaattgaacaatgagatcacatggacacaggaaggggaacatcacactctggggactgttgtggggtggggggatggggggagggctagcatggggacatatacctaatgctaaatgacgagttaatgggtgcagcacaccagcatggcacatgtatacatatgtaactaacctgcacaatgtgcacatgtaccctaaaacttaaagtataataataaaaaaagaaaaaaaaagatatatcctttttcaaagttggcctcaaggcactcccaaatatcctttcacagattctaccaaaaaagtgtttccaaactgctgaatgaaagaaagttttacctctctgagatgaatgcacatatctcaaggcaatttctcagatggtttcctcctagtttttaacaagggatactcactttttcccctatggcctaaatgaactccaaagtatcccttcagaaattgtacaacaacaatgtttccaatctacagaattcaaagaaaggtttaactctgtgagatgaatgtacacatcacaaagcagtctctcagaaagcttctttctagttttaatctgaagatatttcatttttcaccatagccctcaatgcactccaaaatataccttaaggattctaccaaaacagtgtttccaaactgctgaatgaaaaaagttttaactctgtaagatgaatgcacacatcacaaggcactttctcatatagcttccttctagttttcatcctgggatattcactttttgccctattgcctcagcgagctcccaaatatcccttcgcagctctacaacttttccaagtggtgaatccaaagaaagttttaactctgtgagatgaatgcacatgtcacaaagcattttcttggaaagcttatttcttatttttatctgagatatttcctttttcaccataggccccaaagcactctgaaatatccatatgcagttcctaccaaagcagtgtttacaaacagctgaatgaaaaataatgtttacttctatgagatgaatgtacccatcacaagtcagtttctcacatagcttccttttagtttttgtcctgggatagtcaccttttcacctatggcctaaatgagctatcaaatatcccatcgcagaaaaaaaacaaaaaaagtgtttccacactgctgaatccaaataaaacttcaactctgtgagaggaatacacacatcacgaagcagtttctcagaaagcttctttcaagtttttatgtgaagatatttcctttttcaccacaggcctcaatgcactcccaaatatacctaggaagattctaccaaaatgttgcttacaaattactgaatgaaaagaaaggtttaactctgggagatgaatgcacacatgacagtgcagtttctcagacagcttcctgctagtttttatcctgagatattagctttttcacctatggcctcaaagagctatcaaatatctcttctcactttctacaaaagcagtgtttccaaactgctgaatccaaagaaaggtttacctcagtgagataaaatcacacatcacaaagcagtttctcagaaatcttccttaacgtttttatctaaagatattttctttttaaccataagcatcattgcactcccaaatatccattcacagattctaccaaaaaagagtttcaaaattgttgaatgaaaagaaaggataaattctgcaaaaggaatgcacacatcacaatgtggtttctcagatagctttcttgtatttttatcctggtatattcaccttttcaccttaggcctcgatgatctcccaagtttcattttgcataaaggacaaaaacagtgtttccacactgctgaatccaaagaaaggtttaactatgtgacatgaatgcacacatcacaaagcagtatctcagaaagcttctgtctggtttttatctgaagatatttcctttttcaccttaggcctcaatgaactccctaatatccttttgtagattctacaaaaacagtgtttccaaactgctgaaagaaaagaaaggtataactctggaagatgaatgcacaatgcagtttctcacacagcttccttctagattttatcctgggatattcactttttcacctatggcctcaatgagctatctaatatcttctcagattctacaaaaacagtgtttccaacctgctgaatccaaagaaaggtttacctctgtgagataaatgctcacatcacaaagcagttcctcagaaggtttctttcaatttttatctgaaggtatttcctttttaaccataagcctcaatgcactccaaaacatccctttgcagtttctaccaaaacagtgattcgaaattgctgaatgaaaaaaaagatctaactcagcatgatgaatacatgcatcataaagttgtttccctcatggctttcttgtgctttttattctgggatattcactttttcgacattggcctcaatgagctatctaatatccttcctcagattgtacaaaaacagagtttccaaactgctgaatcctaagaaaattttaaatctgttagacgaatgcacatatcacaaagcagtgtgtcacatatcttccttctagtttttatgtgaatatatttcctttttcaacagatgtctcaatgcactcccaaatatccctttgctgattcacaaaaacagtgtttccaaactactgaacacaaggaaatgttcacctgtgtgagatgaatgcatacatcacaaaggggtttctcagttagactccttctagtttttatcatgggatattcactttgtggcgtttggcctcaatgagctctctaatatcccttttcatattctacaaaaccagtgtttctaaactgctgaataaaaaaacgttttacatctgtgaaatgaatgcacacatcacaaagcagtttagcttctttctagttttcttttgaagatattttcttttacaccatactcctcaacgcactccctaatatccctttatggatactaccaaaacagtgtttccaaactgctgaatggaaagaatgttttaactctgtgggatgattgaacacatcgcagagctgtttctcagatagctttctcgtattttttatcctgggatattcacttttttgccattggctaaataagctacctaatatccctgtgcagactctacaaaaacagtgtttgcaaattgctgaatactaagaaaggtttaactctctgagacgaatgcacacatcacaaaccagtgtcacagaagaaagcttctttctagtttttatctggagatatttcctttttcaacataggcctcaaagcactccccaatatccctttgtagattctacaaaaacagtgtttccaaactacagaatgaaaagaaaggattaattctgagttgaaagcacacagcagaaaagcggtttctcagatacctttcttctagtttttatcctgggatatttgctttttcactttggcctcaatgtgctcccaaatgtccattcacagaatggacaaaaacagtgtttccaaactgccaaatctgaagaaagttttaattatgtgagataaatgcacacatcacaaagcaatttctcagaaagcttccttctagtttttatctgaaaatatttcctttttcactgtaagcctcaatgcattcccaagtatctcttcacagacactaaaaaagcactattcccaaactgctgaattaaaagaaaggtttacctctgcgagatgaatgcacacatcacaaagtggtttctcaggtactttccttctagtttttgtcctgggatgctcactttctcaccattggcctcaatgaacttgaaattatccctttgccgattctacaaaaacagtgtttccaaactgctgaagaaaaaatgttttatctcagtgagatgaatgtagatatcacaggtggtttctcagaaaccttccttctagtttttaacctgagatattggctttttcccatggcctcgatgagctatcaaatatcccttcacagatgctacaaaaacttttttctccaaattgctgaatccaaagaaatatttcaatttttgaaatgaatgcacacatcacaaagcagtttctcagaaagtttctttctaatttagatctgaaaatatttttttttcaccatagaccttgatgcactcccaaatataccttcatagatactaccaaaacagtgtttccaaactgctaaatgaaaagaaaggtttatctctgcgagatgaatgcatgcatcacaaagaggtttctaagatagtttccttctaatttttgtcctgggatgttttatttttctccattggcctcaatgaactccaaaatatccctttgcagattctaccaaaaccgtgtttccaaactgctgaatgaaaaaaagttttatctcagtgaggtgaatgtagatatcacaggtggtttctcagataccttccttctagtttttaacctgggatattggctttttccccatggcctcaatgagctatcaaatatcccttcacagatgttacaaaaacttttttctccaaattactgaatccaaataaatgtttcaatttttgagatgaatgcacacatcacaaagcagtttctcagaaagtttctttccagtttagatctaaaaatattttttttcaccataggccttgatgcactcccaaatatcccttcgtggatactaccaaaacagtgtttccaaactgctaaatgaaaagaaaggtttaactttgtgagatgaatgcacacatcacaaagaggtttctcagatagtttccttctaatttttgtcctgggatgttttctttttctccattggcctcaatgaactccaaaatatccctttgcagattctaccaaaacagtgtttccaaactgctgaatgaaaaaaagtttatcttagcgagatgaatgtagatatcactggcagtttctcagatatcttccttctagtttttatcctgggatattggctttttcccctgtggcctcaatgagctatcaaatatcccttcacagatgctacataaacttttgttttccaaattactgaatccaaagaaacgtttaaatttttgagataaatgcacacatcacaaagcagtttctcaggaagtttctttctagtctagatctgaagatatttcttttttcaccataggcctcgatgcactcccatcgaggataacccttcacagatactaccaaaaaagtgtttacaaactgctgaatgaaaagaaaggtttaactctgtgagatgaatgcacacataacaaagtggtttctcagatagctttcttttagttttcatcctcggatattccctttttcaccattggcctcaatgatctcccaaaagtccattcacagaataaacaataacagtgtttccaaactgctgaatccaaagaaaagtttaactctttggggctaatgcacatgtccaaaagaagtttctcagaaagcttcttgctggtttttatctgaggatacttcctttttcaccataagcctcaatgcgttcccaaatatcccttatgcatattctaccaaaacagtgtttacaactgctgaatgaaaagaaagttttaactctgtcaattgaatgcacaaatcacaaagcagtttctcagatagctttcttctagattttatcccgagatattcacttttttgcctttggcctcagtgagctctcaaatgtccattcatagaatggacaaaaacagtgtttccaaactgccaaagccaaagaaaggtttaactctgtgagatgaatgcgcacgtcacaaagcagtttttcagaaagcttctaactagtttttatctgaagatatttccactttcaccataggcctcaatgagctcccaaatataccttcgcagattctaccaaaacagtgtttccaaactgtagaatgaaaagaaaggtttaacactttgagttgaaagcaacagcacaaagcggattcttacatagatttcttctagtatttttctggggatattgtctttttcaatttggcctcaatgaggtctgacatgtcctttcatagaatggactaaaacagtgtttccaaacgtctgaatccaaagaaacttcaactctgtgagagaaatgtactagtcatacagcagtttcttggaaaaattctgtctagtttttatctgaagatatttcccttttcaccaaaggcctcaatttgctcccaaatatcccttcttagatactacaaaaacagtatttttaaattgctgaatgaaaagacagttttacctttgtgtgtgaatgcacacatcacaaagctgtttttcaaatagcttccttcttgttttaatcctgggatgttcactttttccccattggcctcagttagctccaaaatatctgttcacagattccacaaaaacagtgtttccaaactactgaatccaaagaaagttttaactctgtacccatcacaaagcagtttctcagaaagcttctgtctagcttttatctgaagatatttcctttttcactataggcctcaaggcactcccaaatataacttcacagattctaccaaaagagtgtttccaaactgctgaatgaaaagaaagttttaactctgtgagatgaatgtagacttcacaaggccgtttctccgataccttccttttagttttcgttgtgggatattcattttttccactatgccctcaatgagctctcaaatatcccattgcagatgtgaaaaaagcagtgtttccaaattactgaatccaaacaaacatttggatttctgagatgaatgcacacatcatgaagcagtttttcagaaatcttgtttctagtttttatctgaagatatttcttttttcaccataggcctcaatgtgctctcaaatatctctttgcagaatctaccaaaatggtgtttccaaattgttgaatgaaaagaaaggtttaactctgtgagatgaaagcaaccatcacaaaggccttcatcagagaccttccttctagtttttatcatgggatattcactttttcacctatggcctcaatgagctctctaatatccattcacagattcaacaaaaacagtgtttccatgctgctgaatacaaaaaaaacgtttacctctgtgagatgaatgtgcacatcacaaagcagtttcccagaatgcttctttccagtttttattggaagatatttcttttttcaccatagtcctcaatgcactcccaaatatcccttcacagtttctaccaaaacagtgccttcaaattgctgaatgtaaagaaacttttaactcggtgaaatgaatgcacacagcagaaagtggtttctcagatagctttcttctagttttcatcttgggatatttgctttttctccattggaatcaaggacctcccaaatctccattcgcagaatggacaataacagtgtttccaaactgttgaatccaaagaaaggtttaactttgtgaggtgaatgcacctgtcccaaagcagtttctcagaaagcttcttgctagttttcatctgaagatacttcctttttatccctaggcctcaatgggctcccaaatatccattcacagattctacaaaaacagtgtttccagcctgctgaatgaaaaggaagtttaaccactgcgagcttaatgcacacatcacaaggtggtttcttagatagcttttttctagtttttatcctgggatattcactttttccccctatggcctcagtgagctcccaaatatcccttcacagattctacaacaagtgtgtttccaaactgctgaatcaacaaaaaagtttaactctgtgggatgaatgaacacattacaaagaagtttctcagaaagcttctgtctagtttttatatgaagatatttctttttcaccggagtcctcaaagggctcccaaatattcctttgcagattgtacaaaaagactgtttccaaactgctcaatcaaaagaaagtttcaactctgtgagatgaatggacactttaaaaagcagtttctcagaaaacttctttctggtttttagctgaagatatttcctttttcaccattagcctcaatgcactcccagatatccctttgcagattctacaaaaacagtgtttccacactgcagaatgaaaagaaaggtttaactgtgccagagaaatgcacacatcacaaagcagtttctcagatatatttcttcaagttttcatactgggacattcacttttttgccattgacccaaatgagctcaaaaattgtccattcacagaaaggacaaaaacagtatttcaaaattgctgaatccaaagtaaggtttaagtctatgaggtgaatgcacacatcaaaaagcagtttgtaagaaagtttctttctggtttttatctgaagatatttcctttttccccatacaactcaaagctctcccaaatatcacttagtgtattctgtcaaaacagtgtttccagactgctgaatgaaaagagagattaattctgcaggatgaatgcacacatcacaaagtggtttctcatatagcttttgtctaatttttatcctgggatattgtctttttcaccattggcctcaatgagctcccaaatgtccatttgcagaatggacaaaaatagtgttagctaactgcagaatccacagaaagttttaactctgtgatttcaatgcatacttcagacagcagtttctcagaaagcttctttctagttttaatctgaatatatttcctttttcactataagcctcagtgcactcccagatatcccttcacagattctacaaatacagtgtttccaagctgctgaatagaaagaaatgtttaattctgcaagatgaatatgcacatcacaaagttgtttctgaaatagcttccttctagtttttgtcctgagataatcacttttttgcctttggcctcattaagctcccaaatgtcccttcataaattctacaacaacagtgtttccaaaccactgaatccaaagaaaggttgtactctgtgagatgaatgaacacatagaaaagcagtgtctgataaagtctctttgtatttttaatctgaagatatttcctttttcaccataggcctcaatgtgctccaaaatgcaactttgcagattctacaaaaacagggtttgcaaactgctgaatgaaaagaatggtttaaatctgagaaatgaatgcacacatcacaaaccggctcatcagatagcttcttcctacttttttttttttcctgggatgttcacttttttgcctttggctctgtcagcttccacatgtccctacacaaatactaaaacaacagtgtttccaaactcctgaatccaaagaaaggtttaaccctgtgatatgaattcacacatcacaaagcagtttcttagaaagcttctttctagtttttatctgaagatatgtcatttttcaccataggactcaatgcgttcccagatatttcttcatggatcctgtgaatacagtgtttccagactgctgaatgaaaagaaaggtttctctctttgaggtgaatgcaaacatcaaaaagctgtttctgagatagctttcttctagttttatcctggggtattttccttttcaccattgaccaaaggacctccaaaatgcccattcatagaatggacaaaaacagtgtttgcaaactgctgcatccacagaaaggtttaaatctgtgagaggaatgcacacatgacatagcaatttcccagaaagcttcttgctagtttttatatgaggataattcctttttcaccggaggcctcactgcactccaaaatataatttgcaaattctacaaaaaaaaaaaggtgtttccaaactgctgaatggaaagagtggtgtaacatcacaaagcggtttctcagataactttcttctatttttttcctggaatatttgctctttcatctttttcctctgtgagctctgaaatatcgcttcacagattccacaacagtgttcacaaactgcagaatgcaaagaaaggtttaactctgtgagatgaatgtacacatcacaaagtagtttctcagaaagcttctttttagtttttatctgaagacatttcctttttcaccataagcctccatgtgctgccagtaatcacgtcacagattctaccaaaatagtgtttataaactgctgaatgaatagaaagttttatttctggtagatgaatgcacacattacaaagcagtttctcagagagcttccttccagtttttattctgggatatttgcttttttaccattggactcacagagctcccaaatgtccattagcagaatggacaaagacaccatttggaaactgctgaatccacagaaagttttaactctatgagattaatgcaaacatcacaaaacagtttctcagaaagtttcatctaatttttatctgaagatatttcttttttctgtaggcctcaaagcactcccagatatccacttggagtttctacaaaaacagtgtttccaaactgctgatataaaagaaagttttaaccctgtgaaatgaatgcccacataacattggtttttctgattgcttccttctagttttttttcccctggaatattcactttctcaccagtcaccttaatgagctctggaatatcccttcacagattctaaaacaactgtgtttccatctgctgaatccaaagaaaggtttaactcggtgagatgaatgcacacatcccaaatagtttctgagaaagcctctttctagtttatattttaaaatatatcctttttcaccataggcctccaggtgctctcaaatatccctttatggattcttccaaaacagtgtctccaagcagctaaatgaaaagccatgtttatctctgtgaggtgaatgcacacatcacaaaactgtttctcagatagcttacttctagtatttatcctgggatatttgctttttctctgttagcctcaatgagctcctaaatgtccacttgccgaatggacaaaaacagtgtttgcaaatggctgaatacacagaaaggtttaattctgtcaggggaaagcacatatcaaagcagtttctcagaaagattccttctagtttttttctgatgatatttcctttttcaccataggcttcaaagcgctcccagatattcgttcaaagattctatgaaaacagtgtttccaaactgctgaatgaaaggaaaggtttaactatgcaagatgaatgtacacatcacaaagtgatttctcaaatagctcccttctagtttttatcctgggatactcactttttcaccattggcctcaatgagctcccaaacatccctttgcagattctacaataacagtgttcccaaactgctgaatccaaagaaatatttaactctatgagaggaatgcacacagcacaaagcagtttctcagaaagcttctttatagtttttatctgaagatatttcctttatcaccacaggcctcattgtgctccaaaatatccattcacagattctatgaaaactgtttccaaaccgctgaaagaaaagaaaggtgagatgaatgcatacatcacaaagcagtttctcaaatcacttccttgtaattttttcctgatataatcactttttcaccattggccttaatgagctccaaaatgtccattcacagaatggacaacaacagtgtttgcaaactgctgtatccaaacaaagtttaactctgtgagatgaatgcacacatcacaaagtagtttctcacaaagcttctttcaagttttggtctgaagatatttactttttcaccataggcctctttgtgatccttaatcatcccttcatggattctgccaaaagtgtgtttcaagactgctgaatgaaaagaaaagcttatctctgcgaggttattgccctcatcacaaagcggtttctcagcttccttctagtttttgtcctgggatatttaccttttcaccattggcctcaatgaattcccaaatgtccattcacagagtagacaaaaacagtgttcgcgaatggctgaatcaaaagaaaggttaaattctgtgagataagtaaagacatcacaaagcagtttctcagaaagcttccttctaatctttatatgatgatatttcttttcaccataagccacaatgtgctgccaaatatcccttcgtggagtctacaaaaactgtgtttccaaactgctgaacgaaaatagaggttttgaatctgtgagttgaataaacacatcaaaaagcagtttctcagatagtttaattgtagtttttatcctgggccatttgctttttcacctttgccctcagcaacatcccaaatgtccatttgcagagtggacaaagacagagttaccaaactgctgaatccaaagaaaggtttaattttgtgaggtgaatgcaaacatcccaaatcagtttctcattaagcttctttctagtttttatctgaatgtatgtcctttttcactgttggcttccatatgcttccaaatatctcttcacagattataagaggacagtatttccaaactgctgaatgaaaagaaaggtttattcctgtgagttgaatgcaaacatcacaaattggtttctcagataacttccttctaacttttatactgggatatttgtttttttgccattggctgcaataagctcccaaatgtccattttgcaaaaatggtgtttctaaactgctgaatttgaagaaaggtttaactctatgaggtgaatgaacacatcacaaagcagtttctcagaaagctccttgctagtttttaactgaagatattctgcttctcaccataggcctcaacgcactgccaaatatccttctgcagattctacaaaaacagggtttccaaagtgctgaatgaaaagaaagggtgaattctgctacatcaatgcacacatcacaaacgcgtttctcagagagcttacttctagtttttatccttggatattcgcttttttgcctttggcctcagtaagctcccaaacgtccattcccagaattgacaaaagcagctttaccaaactgctgaatcaaaagaaaagtttaactctgtgagatgaatggacacatcccaagccagtttctcattaagcttctttctagtttttatctgaatatatttcatttttcaccgctgacctcaatactgttccaaatatctctttgcagattctaataaaagagtttttccaaactgctgaatgaaaagaatgttttaactctgtgagactaaagcacacatcacaaatttggttctcagataacttccttctagtttttaacctctggtattcactttttgccattggcctaaatgggttcccaaatgttcatttgcagaatggacaaaaacaatgtttccacacgactcaatccaaagagagctttaactctgtgagatgaatgaacacatcacagagcagtttctaagaaagcttctttttagtttttatctgaagacatttcctttttcaccataggcctcaatgtgctcccaaatatccttttgcatattctataaaacagtgtttccaaaatgctgaatgaatagaaagatttaagcctttgagatcaaagcacacatcacaaagcagtttctcagatagcttccttctagtttttatcttgggatgattgcttttttttgccactggcctcagtggactcccaaatgtccattctctgaatggacaaaatcagtgttacccaatttgtgaatccaaagaatgctttaactctctgagaagaatgcacacatcccaaaccagtttctcattaattttcattctagtttttatctgaaggcatttcctttttccacataagagtcagtgcacaatcaaatatctcttcacagattctaagaaaacagtttttccagactgctgaatgaaaagaaatgtttaactctgtgagatgaatgcacacatcacgaatcagttttgcagataacttccttctagtttttatcctgggatattcactttctcgccattggccccaaagagttcccaaatgtccattctgcaaaaacagtgtttccaaactgctgaattcaaacaaaggtttaactctgtcagaggaatgaacacatcataaagcagtttctcagaaaggttctttctagtttttatctcaagatatttcctttttcaccataagcctcaatgtgctgccaaatatcctttcccagattctacaaaaacagtgttcccaaactgctgaatgaaaagaaagttttaactgtcctagatgaatgcacacataaaaagccgtttctcagagagcttccttcttgtttttatgttgggatatttactttttgtcctttggcctcaatcagctctgaaaggtacattcacagaatgggcaaaaacagtgttacaaaactgctgaatcaaaagagaatttaactctgtgagatgaatgcacacatcccaaaccagtttctcattaagcttctttctaatttttatctgaagatacttcctttttcaccagaggccccaatgcactaccaaatatctcttcgcagattccaagaaatcagtgtttccaaactgctgaatgaaaagaaatgtttagctctgtgagatgaattcacacatcacaaatcggtttctcagataacttccttttagtttttatcctaggatattcattttttcaccatcggtgtcgatgagctccgaaatgtccattctgagaaaagacaaaaacagtgtttccaaactgctgaatccatagaaagttttaaatctgtgagatgaatgctcacatcaaaaagcagtttctcagaaatcttctttctagtttttatctgaagatgtttcctttttcaccataggcctccatgcactgccaaatatcccttcacagattctacaaaaacagtgtttccaaactgctgaatgaaaagaaaggcttaactctgtgagttgaatgcacacatcactaagcagtttctcagataccttccttctagtttttatcctgggatattctctttttcgccattgtcctcagtgagctcccaaatgtccattcacagaatggacaaaaacagtgttaccaaactgctgaatccaaagaaagttttaactctctgagatgaatgcacacatcccaaagcagtttctcattaagcttctttctagtttttatctgaagatatttcctattcaccctaggccccaatgcattaccaaatatctcttcatagactctaagaaaagagtgtttccaaactgctgaatgaaaagaaagatttaatgctgtgagatgaatgcccacatgacaagtcagtttatcagttaacttccttttagtttttatagtgtgatattcccttttttgcccttggcctcagagttcccaatagtccacttgcagattggacagtaacagtgtttgcaaactgcagaatccagagaaatgtttaactctgtgagatgaatcaacacatccacagcggtttctcagaaatcttctttccagtttttctctgaagttatttcgtttttcacaataggccttaatgcactgccaaatatacctcgcaaattctacaaaacagttttatcaaactgctgaatgaacagaatgttttacctctgtaagatgaatgcacacatcacaatgcagtttttcagatagattccttctagtttttatcctgggatattcacttttttgccattggcctcaatgagctcccaaaagtccattcacagaatggacaaaaacagtatttccaaacagctgaatctaaagaaaggttttactctctgagatgaaagcacacatcccaaacctgttactcattaagcttctttcttttttttaatccgaaggtattacatttttcaccagaagtctccatattcttccaaatatctctttgcagattctaaggaaacagtatttccaaactgctgaatcaatagaaagttgtaaccctgtgagatgaatgaacacatcagaatgcagtttctcagaaagctgctttccagtttttatctgaagatatttcctttttcaccataggcctgaatgtgctgtcaaatatcccttcgcagattctataaggacagtgtttccaaactgctgaatgaaaagaaaagttaactctgcaagataattggagacatcacaatgcagcttatcatatagcttccttctagtttttatcctgggatagtcactttctagactttgacctcagtgagcccctaagtgtccattccaagaatggacaaaaactgtgttactgaactgctgaatccaaagaaaggttttactctgagatgaatgcacacatctgaaaccagtttctcattaagcttctttctaccttttatctgaagatatttcctttttcaccataggtctccatatgcttctaaatatctatttgcagactctaagaaaacagtatttccaaagtgctcaatgaagagaaagttttaactctgtcagatgaatgcacatttcacaaatcagtttctcagataacttccttctagttttcatccagggatatatgctttttcaccattttcctcaatgagctcccaaatctccattcacagaatggacaaaaacagagtttccaaactgctgaattcaaagaagtgtttaatgctgagaaataaataaacatatcataaagcagtttcttagaaagcttctttgtagtttttatttgaagatatttcctttttcaccataggcctcaatgggctgtgaaatatcccttggcagattctacaaaaacagtgttccaaactgctgaatgaaaagaaacgtttaactctgtgagataaattcccacatcataaagaggtttctcagatagcttccttctagtttttatcctgggatattcactttttcaccattggcttcaatgagctcccaaatgtccattcacagaatggacaaaaacagtgttaccaaactgctaaaatcaaaggaaagtttaactctttgagattaatgctcacatcccaaaccagtttctcattaagcttctttctagtttttatttgaagatatttcctttttcaccataggactcaatgcactaccaaatatctctttgcagattctaagaaaacagtgtttccaatctgctgatgaaaagaaagttttaactgtgtgagatgaatgcacacatcacaaatcagtttctcagatagataccttctactttttatcctgggatattcactttttcaccattagtattaatgagctcccaaatgtccattcgcagaatgggcaaaaagagtgttaccacactgctgaatccaaagaaaggtttaactctctaagataaatgcacacatctgaagccagtttctctttaagcttttttcttgtttttatagaggagatttcctttttcactgtaggtctccaaagtcttccaaatatcacttctcagattctaagaaaacagtgtttccaaactgctgaatggaaggaaagttataactctgtgagacgaatgcatacatcacaaattggtttctcagaaaacttcctctagttctcatccctggatattcacattttctcctttggactcaaatagctcccaaacgtccaatcacagaatggacagaaacaatgtttccaaactgctgaatgaaaagaacagtttaactctgctaggtgaatgcacacatcacaaagtggtttctcagatagcttccttctagttttaatcctgggatattcattttttcacctttggcctcaatgggctcccaaacctccacttacataatggacaaaaaaagtgttaccaaactgcagaatccgaacaaaggtttaagtctgtgaaatgaatgcacacaacccaaactattttctcattaagattgtttccagtttttatttgaaaatatttctgttttcaccatgggcctcaatgcattacaaaatatcctttcacagattctaagaaatcattgtttccaaactgctgaatgaaaagaaagatttaactgtgtgagataaatgcacacatcacaaatcagtttctcagaaaacttgcttctagtttttatcctggtgtattcactttttgccattgccctcagtgagttccccagtgctgaatccaaagaaagttttaactctgtgaagtgaatgaattcttcacaaagcagtttgtaagaaagcttctttctagttcttatctgaagatatttcctttttcaccataggcctcaaatctctgccaaatatctctttgcagattctaatatatcagcgtttccaaactgctgaatgaaaataaatgctaaactctgctagataaatgcacacttcacaaaatgctttctcaaatatcctccttctagcttttatcctgggttattcactttttcacctttggcctcaaagagctcccaaatgtccattcgcagaatgacaaaaacagtgttaccaaactgctgaatccaaagaattgtttaaacctctgagatgaatgtacacatcacaaacaactttctcattaagcttctttctggattttatctgaagatatttcctttttcaccataggcctcaaagcaatacaaaatatctttttacagattctaagaaaacagcgtttccaaactactgaatgaaaatagttttaactctgtgagatgaacacacaaaccacaaagtgatttctcagttagcttgcttctagttttttttctgggatattcacttttttgcccttggtctcaataagctctcaaatgtccattcacagaatggacaaaaacagtgttaccaaactgctgaatcaaaaggaagttttaactctgtgagatgaaagaacacatcacaaagcagttaattagaaagcttctttctagtttttatcttatgatatttcttttttcaccataggcctctatgcactgccaaatatccgtttgcagatactacaaaaacagtgtttacaaactactaaatgaaaacaaaggtttaactatgctagatgaatgcacacatcacaaagccatttctcagagagcctccttctagtttttatcctggaatattcactttttcaccataggactcaacgagctcccaaatgttcattggcagaaaggacaaaaacagtgttaccaaactgctgaatccaaagaaaggtttaactccgtgagatgaaagcacagatcaaaaagcagtttctcattaaacttctttgtggttttaatgtggagatatttcctattcaccatagtcctcaatgcactacaaaatatctcttcacagattctaagacaactgttttgaaactgttcaattaaaagaaaggcttaactctttgagatgaatgcacatgtaacaaatcagtttctcagacaaattccttccagtttttagcctgggtactcaatttttcaccattggcctcaaagagctccaaaatgtccattcgcagaattgacaaaaacagttttaccaaaattctgaatccaaagaaaggtgtaactctgtgaaatgaatgcacacatctgaaaccagtttctcattaatgctttttctagttttcatctgaagatatttcctttttcactataggcctcaatgcgcttctaaatatctcttcacagattctaagaaaacagtgtttccaaactgatgaatgaaaagaaaggtttaacgctctggagatgaatgcacagatcccaaacgattttttattatgcttctttctagtttttatctgaatgtatttcctttttccctgtaagactaaatgcactgtgaaatatctctttgcagattctaagaaaacagtatttccaaactgctgaatgaaaagaaaattttaaccctgtgagatgaatgtacacatcagaaatcagtttctcatataactactttctagtttttatcctaggatattcacttttgcatcactggcctcgatgaactcaaaaatttccattcgcagaaaggataaaaacagtgtttccaaactgctgaattaaaagaaaggtttaactatgtgagatgaaagaatgcatcacaaagcactttctcagaaagcttctttctagtttttatctgaagatatttcctttttcgccataggcctcaatgagctgccaaatatccctttgcagattccacaaaaaaagtgtttccataccggcgaatgaaaagaaaggtttaactctgctaaatgaatgtccccatcacaatgcagtttctcagatagcttccttctagtttttatcctgggatattcgctttttcaccatttgcctcaatgagatcccaaatgtccattccaagaatggacaaaaacagtgttcccaaactgctgaatccaaagaagggtttaactctctgagatgaatgcacacataccaaaccagtttctcattaagtttctttctagtttttctctgaaggtatttccttttacaccattggcctccatactcttccaaatatctctctgcagattctaagaaaagagtgtttctaaagtgctgaacaaaaaaaaaaaaaattaactctgtgagatgaatgcacacaacatgaatcagtttctcagagaacttacctctagtttttgtcctgagatatttgctttttcaacattggccacaatgagttccaaaatgtccattctaagaatgggcaaaaacagtgtttccaaagtgctgaatccaaagaaagatttaactctggtagaggaatgcccacatcacaaagcggtttctcagatagtttccttctagtttttatcctgggttattcacttttttttgccattggcctcaatgagctcctaaatgtccatttgcagaatgaacaaaaacagtgttaacaaactgctgaatccaaagaaaggtttaactctctgagattaatgcacacattccaaatcagtttctcattaagctcctttctaggttttatctgaagatatttcctttttcaccattgtcctccatactcttccaaatatctcattgcagatttcaaggaaacattgtttccaagctgctgaatgaaaagaaagttttaactctgtgagatgaatgcacacatcacaaatcagtttctcagataactgccttctagtttttatgctgggatatatgctttttcaccattggcctcaatgaactcccaaatgtccattcacagaatggagaaaaatagagtttccaaacttctgaatccaaagaatggtttaactctgtgagatgaatgaacacatcacaaagcagtttctcagaagttctttctagtttttatctgaagatatttcttttttcaccataggctgcaatgcactcccaaatatccctttggggattttgccataacagtgtttccagactgctgaatgaaaagtaagttttacttctgcgaggtgaatgcacacgtcccatagctgtttctcagatagcttccttctaatttttatcctgggtttatccgggcttttttaccattggtcacaaaggactcccaaatattccttcgcagattctacaacaacagtgttttcaaattgctgaatcctcacaatggtttaactctgtgaggtgaatgcacgcatcacaaagcagcttctcagaaagcctctttctagttttttttctgaagatacttcctttttcaccatatgacccaaagcactccgaaatatcacttcgcagtttctacaaaaaaagtgctccgaaactgctcaatgaaaagaaaggtttaactttgcgagatggatgcacacatcacaaaccagtttctcaaagagctttcttctagtttttatcctgggatattcagttcctcaccattgacctcaatgagctcaaacttatcccttcacatattctacaaaaacagggtttccaaaatgctgaatccaaagaaagttgtaactttggagttcgatgcacctatcacaaagccatttctcagaaagcttctttatagtttttatctgaagatatttcttttttcaacattggcctcaataagctcccaaatatcccttcagggattctgccagaacagcgtttccagattgctgaatgaaaagtaagttttacttttgtgacgtgaatgcctacatcacaaagtggtttctcagatagcttccttctagtttttatcctggaatatttgctttttcaccattggcctaaatgaactctcaaataccccttcactgattcaacaacaacagtatttccaaactgctgaatcaaaagaaattttaactctgtgagatgaatgcagatatcacaaagtagtttcccagaatgcttctttctagtttttctctgaagatagttcctttttcaccatcaacctcaatgtactcccaaatacctccttgtggattctgccaaaacagtgtttcagacagatgtgtgaaaagaaagttttattttattttattattattgtactttaagttttagggtatttgcgtacaatatgcaggtttgttacatatgtatacatgtgtcatgttggtgtgctgcacccatcaactcgtcatttagcattagatatatctcctaatgctatccctcccccatcccccgaccccacagcagtccccagtgtgtgatgttccccttcctgtttctatgtgttctcattgttcaaagcccacctatcagtgagtacatgcagtgtttggtttttgttcttgtgatagtttgctgagaatgatggtttgcagcttcatccatgtccctacaaaagacatgaactcatcatcactggccattagagaaatgcaaatcaaaaccacaatgagatatcatctcacaccagttagaatggcgatcattaaaaagtcaggaaacaacaggtgctggaggggatgtggagaaataggaacagttttacactgttggtgggactgtaaactagttcaaccattgtggaaatcagtgtggtgattcctcagggatctagaactagaaataccatttgacccagccatcccattactgggtatatacccaaaggattataaatcatgctgcttaaagacacatgcacacatatgtttattgtgccactattcacaatagcaaagacttgtaaccaacccaaatgttcaacaatgataaactggattaagaaaatgtggcacatatacaccatggaatactatgcagccataggaaagaaaatcttaaccctgcgagctgaatgcacacatcacaaagtggtttctcagtagcttctttctagtttttatcctagaatagttactttttttgccattggcctcaatgagctcctaaatgtccatttgcagaatggacaaatacagtgtttccaaactgctgattccacagaaaacgttaactctgtgaaatgaatgcacacattgcagatctgtttctcaattagtttccttctagtttttatcctgggatattctgttttatgccattgacatcaatgagttccaaaatgtccatttgcagtaagtccaaaaacagtgtttgcaaactgctgaatccacagaaaggtttaactctgtgagttcaatgcacacatcacaaagcagtttctcagaaagtttctgtctagtttttttctgaagatatttcctttttcaatatagtcctcattgcactcccaattatcccttcggggaatcggccagaacagtgtttccatattgctgaatgaaaagtaagttttactctgtgaggggaatgcacacatcacaaagctgtttctcagatggcttccttctagtttttatccttggatactcactttttggctattggtcgccaagagctcccaaatattccttcgcagattgtacaagaacagtgttttcaaactgctgaatccacagaatggtttaactctgtgagatgaatgcgcacatcacaaagcagtttctcagaaagcttctttctagtttttttctgaagatatttactttttcaccacagagcagtttctcaaatactttcattctagtttttgtattgggatatttgctttttcatcattgacctcaaagagttcacaaatatcttttctcagattctacaacaacagtgtttccaaactgctaaatccaaagaattgtttaaatgtgtgaggtaaatgcacatatcacaaagtggtttctcacatagattccttctagtttttaacctgggatattcgcctttttgccattgaccttaaagagctcccaaatgtcccttcgcagattctacaacaacagtgttttcaaattgctgaatcgaaaaacagatttaaatctgtgagatgaatgcacacatcacaaagctgtttctcagaaggcttctttctactttttatctgaagatatttcctttttcaccatttgcctcaatgaacacccaaatatccctttgcggattctgccaaacagtgcttcctgactgctgtcagaaaagagtgttttaactctgcgaggtgaatgcacacatcacaaagccgtttctcagatagcttccttctagtttttatcctagatattctctttttcaccattggccctgataagctccaaaatgtccatccacagaatgaaagaaaacagtgtttgcaaactgctgaatccacagaaatgtttacctctgtgagataaatgcccacatcacaaagcagtttctgagacagcttctttctaatttttatctgagaatatttcctttttcaccttagacctctatgctgtcccaattatcacttcgtggattctatgaaaagagtgtttccagactgctattgggaaagaatgttttaactcttcgagatgaatgcacacatcacaaagcagtttctcaaatatcttcctggaactgcaggtgactgctgccatgcccagctaatttattccatttttagtagagacgggatttcactgtgttacccaagatgatctcaatcttctgacctcgtgatcctccagctttggcctcccaaagtgctgggattccaggcttgagccaccacgcctggactccttcttcaccgtaggtctcaattcactcccagatatcccttcacagattctacgaaaacacggtttccaaattgctgaaggaaaataaaggtttaactctgcaagataattgcacacaccagaaagtggtttctcagatagcttccttctagttttcatcctggaatattcactttttcaccaatggtctcaatgagctctgaaatatcccttcacatattctacaacaatgttgtttccaaattgctgattcaaaacaaagttttaaatctgtcaaatgaaggcacacatcataaagcagtatcttggaaagcttctttatggaaaaagatatttcctttttcaccatagacctcaatgctgtcaaaatatccctttgcagattctgccaagacaacatttccagactgctgtatgaatagaacgtcttaactttatgagatgaatgcacacaccccaaagtggttattcagatactttccttctcgttcttatcctgggatgttccctctttttccattggcctcaattagctcccaaatgtccattcacagattctacaataatgtttgcaaactgctgaatccaccgaaatgtttaactgtgtgatatgaatgcacagatcacaatgcagtttctcagaaagtttctttttggtttttatcagaagatatttcgtttttcaccataggcctcaacgcactcctaaatttccctttgcagattctgccaaaacactgtttccagactactgaatgaaaagaaggttttaactctgcagaaagaatgcacacatcaaaatcaactgctcaaataacttccttctaatttttatcctgggatattcgttttttcaccattggcctcaatgagctctcaaatgtccatttggagaatggacaaaaacagtttttgcaaacttctgaatccacagaacgttttaactctgtgagactaatgccatcatcacaaagcagtttctcagaaagcttatttccagttttaatctgaagatatttcctttttcaccataggcctctttaagctcccaaatatccctacccagattctgccaaaacagtgtttccagacacctgaatgaaaataaagctttaactatacgtggtgaatgcgtatgtcagaaagtggtttctcagatagcttttttataattttttttacctgggatattttcttcttcacctttggcctcagtgagctcccaaatgtcaattcgaatattctacaacactgtttgcaaacagctgaatccatggaaaggtgtaactctgtgagacgaatgcacacttcacaaagaagtttctcagaaagcttctttctattttttatatgaagatatttcctttttcaccatatgcctcaatgtgctcccagatatccctttgcagatgctacaaaaacagtgtttcaatactgctgaatgaaaagaaaggtttaattctgtgagatgaatgcacaaatcacaaagatgtttctcaaatagcttccttctagtttttaacctggtaaacttgcttttttgccatttgacaaaaagggctcctaaatgtccatttgcagaatggacaaaaacagtgtttacaaactgcagaatccacataaagaattagctctgtgaggtgaatgcacaaatcacaaagcagtttctcagaaagcttctttgtagtttttatctgaagatatttcgtttttcaccgtaggcctcaatgtgactttacaaccttgcagattctacaaaaacagttttccaaactgttgaatccaaagaaaggtttaactttgcgaggtgaatgcacacatcacaaggtggtttctcagataatttccatctgctttttatcctgggatattcagtttttcctctttggcttcattaagctcccaagtataacctcacaggatctacaaaaacagtgtttccaaattcctgaatccaaagaaaggtttaaatctgcaagatgaatgcacacatcacaaagcagtttttcaagtagattccttctgattttcatcctgggatattagctatttcaccatttatgtcaaagagctcctaaaagtccattcacaaaatgaacagaaactgtttttcaagctactgaatgatagtaaggtttaactctgtgacttaaatgcacacatcagaaagcagtttctcagaaagcttctttccagtttttatctgaagatatttcctttttcagcataggcctctgtgcactcccagatatctgttcgcagattctgtgaaaacagtctttcctaactggtgaatgacaagagagctttaaatctgcgagacgaatacacacatcaaaaagccgtttctcacatagcttccttctaatttttatcctgggataattgcttttttgtcattggccttgatgaactcccaaatatacgttatcaggttccaaaataacagtgtttccaaactgcagattgcaaagaaaggttgacctatgtgggatgagtacccacgtctcaaagcagtttctcagaaatcttctttctagttttttgtgaagatatttcttttttctccttaggactctatgggctcccaaatatcccttcatgtattctgccaaaacagtgtcacaagagtgctgaatgaaaagcaagttttaactctgtgaggtgaatgcttatatcacaaattgatttctcagatagcgtccttcttgttttcatcctagcatatcactttttcgccattggcctcaaggagctcccaaatatcccttcacagattctacaaaaacagtgtttccaaactactgaatccaaagaaaagtgtaactctgtgagatgaatgcacacatcacaaagcagtttcttagaaatgttctttctaatttttacctgaagatatttcctttttcagcagggggcacaaaggtctcccaaatatcccttcatggattctgtcaaaacagtatttccaggcagctgtatgcaaagaaatgtttaaatcagtgaggtgaatgccacacatcacaaagcagtttctcagatcacttctttctagtttttatcctgtgatattcgctatttcaccattggccccagagagctcccaaatgtcctttcacagaatggacaaaaacagtgtttccaaactgctgattccacagaaaggattaactctgtgagacgaatgcacacatcacaaagcattttctcagaaagcttcattctagcttttatctgaagatatttcctttctcaccatagaccacaaagcactcagaaatatagcttctcagattctacaaaaatagtgtttccaaactgatgaatgaaaagaaaagtttaactctgacagatgaatgcacatatcacaaagcggtttctcagatagcatccttctggtttttttttcctgggatattccctttctctcctatggcctcagaaagctcccaaatatccctttgcagattaaaaaacaacagggtttccaaattgctgaatccaaagaaaagtttaactctgtgagatgaatgcacacatcacaaagcagtttctcagaaagtttctttctagttttatctgaagctatttcctttttcaccatatgcctctatgcgctcccaaatatcccttcacagattcagccaaaagagtgtttccagactactgaataaaaagaaagttttatctctgtgagatgaatgcacacatcacaaagcagtttcctgatagcttctttctagtttttatcatgggatatttgctttttcacctttgacctgaaagagctcccaaatatccattcacagagtggacaaaaacagtggatgcaaactactgaatacacaggaaggattaaccctgtgagatgaatgaacacatcacaaagcagtttctcagaaagcttctttctactttttgtctgcagagatttccttttttggccaggcacggtggctcaagactgtaatcccagcactttgggaggttgaggtgggcagatcacaaggtcaggagattgagaccatcctggctaacacggtgaaaccccgtctctactaaaaatacaaaaaattagccaggcatggtggtgggcacctgtagtcccagctgctcaggagactgagacaggagaatggtgtgaacctgggaggtggagcttgcaatgagccaagattgcaccactgcactttggcctgggtgacagagcaagactccatctccaaaaaaaaaagagttttccttttttatcataggcctttatgtgctccaagatcactttgcagattctaggaaaagagtgtttccaaactgctgaatgaaaaagaagggttaactctgcaagatgaatgcacacatcacaaatcagtttctcataaagcttctttctagttttaatctgaagatatttcctttttcaccataggcctctatgagctccccagtatcccttcatagattctgccaaaacagtgtttctacactgctgaatgaaaaaaaaaaaaagatttacctttgtgagctgaatacacacatcacgaaggcatttctcaaatagcttccttccagtttttatcctgggatattttcttttttgccattagcctcaatgaggtaaaaatgtccaatctcagaatgcacaaaacagtgtttgtaaactgctgaatccatagaaatgtttaactctgtgaggtaaatgcgcacatcacaaatcagtttctcacaaagcttctttctaggttttatctggatatatttccttttttaccataggcatcaatgcactcatagaattcccttcacagatgctacgaaaacagtgtttccaaactgctgaacccaaagaaaggtttaactttgtaaaaagaatgcacacatcataaagcattttctcagaaagcttctttctactttttatgtgaagatatttcctttttcaccataggccataaagcactccgaaatatcccatcgcagattctgcaaaaacagtgtttccagactgctgaatgaaaagaaaggtttatctctgcaaggtgcatgctcacatcactaagcggtttctcagatgatagattccttccagatttcaccctgggatattcttttttttgtcattggcctcaatgagctcccaaatgtcaatttgcccaatggacaaaagcagtgtttgcaatttgctgaatccacagaaaggtttaacggtgtgagatgaaagcttaaatcaccaagcagtttctcagaaagcttctctctagtttttatctgatgatatttcctttttcaccataggcctcaatgcactccaaaacactacttcaccatttctacaaaaatggtgtttccagactgctgaataaaaagaagttttaactctgcaaggtgaatgcacacatcacaaaggggttctcagaaaacttccttctagtttttacctttgatatttgctttctcgccattggcagcaatgagctctcatatatactttcacctctacaacaacagtgtttccaaactgctgaatccaaagaaaggcttaactatgtgagttgaatgcatacatctcaaagcagtttctcaaaaggcttctttctcgtttttatccgaagatatttcctgttttaccataggcctctatgtgctcccaagtatcccttcgtggattctaccaaaagagcgtttccagactgctgaatgaaaagaaggctttaactctgctaggtgaatgcacacatcacaaatccgtatctcagatagtttccttctagtttttattctgggatattctattttttgccattgccccaatgaacgttgaaatgtctacttgcagaatggacaaaaacagtgtttgcaaacagctgaatccacagaaaggtttaagtctgtgagatgaatgcacatattgcaaagcagtttctcagatagcttatttctagtttttatctgaagatatttcatttttcaccataagcctcaatgcgctcccagatagccctttgcagattccacaaaaacagtctttccaaactgctgaatgaaaagaaaggtttaactctgtgaggtgaatgcacacatcacaaagcagtttctcagatgatttcccaactttttgtcctgggatattcacttttttgctatggacctcaatgagttccctaatataccttcagatattctacaacagcagtgtttccaactgttgaattcaaataaatgtttaactctgtgagatgaattcacatatcacaatgcagtttcccagaaagcttctttctagtttttatctgaagagatttcctttttcaccgtaggcctctatgtgatcataaatatcacttcacagatcatgccataacagggtttccagactactgaatgaaaagaaggttttaactctgctaggtgaatgcgcacacacatcacaaagctttatctcagatagcttccttccaatatttataatgggatattcacatctttgtcattggcttcaatgagctcctaaacgtccacttgcagaatggacaaaaacagtgtttccagactgctgaattaaaagaaagatttatttcagtgaagtgaatgcacacatcacaaagtggtttctcagatagcttccttccagtttttataatgggatatttgctttttcacatttggcctcaataagctcccagatatcccttcacagattctacaacaacagtgtttccaaagtgaagactgaaaaaaaaatttaactctgtgagatgaatgcacatatcagaaagcagtttctcagattgcttccctctagtttttttccttgggtgttcgctttttcgacattcactttaatgagatcccaaatatgcctttggagatcctaaaactacagggtttccaaattgctgagtccaaagaaaggtttaactctgggagatgaatgcacatataacaaagcagtttctcggaaactttctaatttttatgtgaagatattttctttctcaccataggactcaacgcgctccctaatatgtctttgcagaatggacaaaagcagtgttagcaaatgtctgaatccatagaaaggattaactctgtgagatgaatgaacacatcacaaagcagattctcaaagagcttcttcatagtttttatctgaaggtatttcctttttcaccataggactcaatgtgatcacagatatcactgcacagattctacaaagtttttccaaacttctaaatgaaaagaaaggtttaactctgcgagatgaatgcacacataacaaagcagtttctcagaaagtgtctttctattttttatcagaatatattttctttttcaccataggcctcaatgtgctcccaaatatcccatggaggattctgccaagacagtgtttccagattgctgaatgaaaagaaaagtttatctctgtgaggtgaattcacacatcacaaagtggtttccaacatagcttccttctagtttttatgctgggatatttcctttttcggccttggcctcaatgaactccaaattttccattcgcctaatggaacaaaacagtgtttgcaaactgctgaatctacagaaatgtttaactccgtgagatgaaagcacacatcacacagcagactctcagaaagcttctttctagtttttatttgaagagatttccttttttcaccataggcatcaatatgctccttagtatcactttgcagattatttgaaaaaagtgttttcaaactgttgaatgaaatgaaaggtttaactctgtgagatgaatgcacacaccccaaagcagtttcacatagagcttccttctagtttttatcatgggatattcatttttttccatcggcctcaatgagctctcaaatatacatttccagaatggatgaaaactgtgtttgcaaaatgctgaacccacagaaagttttaaccctgtgagattattgcctacatcacaaggcagtttcgcagaaaacttgtttctatatttcatctgaagatattttttttttcaccatagggctaaatgcgctcccaaatatcccttctcagattctgtcaaaatggtgtttcctgactgctgaataaaagaaagctttgtctgtgaggtgaattcaaacatcattaatcagtttctcagatagcttccttccagtttttatgctgggatatttgcatttttgacactggccacaaggagctcccaaatatcccttcaaatattctacaacagtgtttccaaattggtgaatccacagaaagtttgaactctgtgagatgaatgcacacatctcaaagcagtttctcagaaagcttctttctagtttttacctgaagatatatcgtttttaaccataggccttaatgtgctcccaaatatcccttcccagattctgccaaaacagtatttccagactgctgtatgaaaagaaagttttatctctgtgaggagaatgcccacatcacagagcagtttctcagatagcttccttctggttttcatcctgagatatttgccttttctccattggtctcaatgggctcccaaatgtccagtcacagaatgtacaaaaacagtgttagcaaactgctgaatcaacagaaagtttgaaatctgtgaggaaagttttaactgtgtgagatgaattcacatatcacaaagcagtttctcacaaagcttctttttaatttttatctgaagatatttcctttttcaccataggcctgtttgtgctcccaaatatcctttggtggattctgccaaaacagtgtttccagactgctgtagcaaaataatgttttatctctgtttgttaggtgaatacacatatcacaaagtgttttctaagatagttttttctagtttttttttcctgggatatttcttttttcattataggtctcaatgtgctcctagttatcactttatagattctatgaaaacagcttttccaaactgctgagtgaaaagaaaagtttaattctgtgacatgaatgcacacatcactaagaggtttctcaaagagcttccatctagtttttatccaaggatattcacttttttgtcattggcctcaatgagttcccaaatgtccatttgcagaatggacacaaaaagtgtttgcaaactgctgaatccacagaaatatttaactctctgagatgaacgcacacatcgcaaagaactttctcagaatacttctttctagaatttttctgaagatatttccttttaaccatagtcctcaatacactccaaaatataacttcacagattctacaaaaacagtgtttccaaactgcttaatgaaaagaaagatttatctctgcaagacgaatgcacatatcaaaaattggtttctcaaatagatttttctagtttttatactgggatattcacttttttttgccattgtcctcaataagctcccaaatatccattcacggcttctacctaaacagtgtttccagactgctgtatgaaaagaaagttttctccctgtgaggtgaatgcatgcatcacaaagttgtttctcagatagtttccttctagtttttatgctgggatattcgttttttcaccactggcctcaaagagctcccaaatataccttcacagattgtaaaacaacagtgtttccaaaatgctgaacccaaagaaaagtttaactctgtgagaataatgcatatatctcaaagcagtttctcagaaagcttctttctagtttttatcctgagatattctcttatttgtcgttggcctcaatgagctctgaaatatctctccatagattctacaacaacagtgtttccaaactgctgaacccaaagaaaggattaactctgtgagatcaatgcacacatcacaaagcagtttctcagaaagcttctttctagtttttatctgaagatatttacttcttcaccataggcttctatgtgctcccaaatgtcactttgcagattatggcaaaacagtgcttccagactgctgaatgaaaagacggtttcaactcagtgagataaatgcacacatcaccacgtggtttctcagacagcttccttctagtttttatcctgggttatttgttttttcaccatcggcctctatgagctccaaaaagtccatttgcagaatggacaaaaccagtgtttgcaaactgctgaatccacagaaaggtttaactctgtgagattaatgtgcacatcacaaagcagtttctcagaaagcttctttccattttttatctgaacatatgtcctttttcaccataggcctcaaaatactctccgatgtcacttcacagattctatgaaaacagtgtttccacactgcccaatgaaaagaaatgtttaattctgtgagaagaagacacacatctgaaagcactttctctgaaagcttctttttagtttttttttctgaagatatttgctttttcaccataggcctcaatacactactaaatattcctttgtggattctgccaaaacagtgtttccagactgctgaatgtaaagaaaggtatatctctgcatagtgaatggacacatcacaaagtactttcttgaagagcttacttctggtttttattctgagatattctttttttggccattgacctcaatgagctcccaaatgtccatttgcagaatggagaaaatcagtgtttgcaaactgctgaatgcacagaaaaatttatctttgtgggatgaatacacacatcacaaagctgttttaaagaaagcttctttctggtttttatctgaagatatttccttttttcaccagaggcctcaatgcactcccaaatataactttgctgattctacaaaagcaatgttccaaactgctgaatgaaaacaaaggtttaactctctgagatgaatgtacacatcacaagtttctcagaaagcttcgttctagtttttatctgaagttatttcctttttcacaataggcctcaatgcgctatgaaatatctctttgcagattctgcgaaaagagtgtttccagactgctgaatgaaaagaaaggtttatatctgtgaggtgaatgcacacttcacaaagtggtttctcggatagcttcctttcagttcttatcctgggatatttgctgtttcaccattggactcaatgagcccccaaatgtccattcatacaattgacataaacagtctttgcaaatgactgattccacagaatcgtttaactctgtgagatgaatgcacacatcatgaaggaatttctctgaaagcttctttctagttttgacctgaagatatttcctttttcaccctagacctcaatgtgttcacagatatgccctcagagatactacaaaaacagtgtttccaaactgttgaaagaaaagaaaggtttaactctgcaagatgaatgcacacatcacaaagcagtttctcagatagcttccttttagtttttttccagggatagttgcctttttgccattggcctcagtgagctcccaaatatcccttcgtaggttctacaacagtgtttctaaactgctgagtccaaagaaacgttttactctgtgaaatgaatgccaacatcagaaagcagtttctcagaaagcttctttcgagtttttatctgaagatatttcctgtttcaccatgggcctcaatgcactccctaatatagctgcacagattctataaaaacagtctttccaaacggctggaagaagagaatggtttaattctgtgaaatgaatgtacacatcacaaagtggtttctcagaaagtttctttctatttttttagaagatactttctttttcaccagagtcctcaatgctctcccaaatacaccttcacagattctacaaaaaaagattttccaaactactgaataaaaaaatgatttaactctgtgatatgaatgcacacatgacaaagaaggttctcagatagcttcattctagttttatccagggatatttgctttttggcctttggcctcaatgacctctcaaatatcctttgatagaatggataaaaactttggattccaaagtgtggaatccaaagaaaggttgaaatttgtgagatgaatgcacccatcacaaagcagtttctcagaaagcttctttgtactttttatctgaagataatttttttcaccataagcctcaaagtgctctcaaatatcacttcacagattctacaaaaacagtgttttcaaactgctgaatgaagagaaaagtaaactttgcagatgagtgcacacatcacaaagcggtttctcacaaggctttcttatagtttttatcctggaatatttgatttttcaccattggcctcaatagctcccaaatgatcatttgcagaatggacaaaagaaatgtttccctactactgaatcaaaagaaagatttcactctgagagctgaatgcacacattacattgcagtttcttagaaagcttctttctagttttcatctgaagacattttcttattcactgtaggcctcaatgcaagcccaaacatccctttgcagattctagaaaagcagtgtttccaaactgctgaatgaaaagtaaggtttaactctgtgagatgaatgcacacatcacaaagcagtttcccagagagattccttctagtttttttcctgggaaaatttattttttgctgttggcctcttttttttatgttttattcttttttttattatacttttagttttagggtacatgtgcacattgtgcaggttagttacatatgtatacatgtgccatgctggtgcactgcatccactaactcgtcctcaacgacctcccacatttccactggcagaatggacaaaaagtgttttcatactgctgaaagaaaacaaaggtttaaatctgccagatgaatgcacacatcacaatacgatttctcatatagcttaattctatggtttataatgggatatgcgttttcttgccttggcctcaaagagcttccaaatttccatttgcagaatggacaaaatccgtgtttccaaactgctaaatcaaaagaaagttttaattctttgagacgaatgcactcatcacaaagcagtttctcagaaacagcaaaaatcccaggataaaagcttgaaaaaacctatctgtgaaactgctttgtgatgtgatcattcatcttgtagaattaagctttcttttctttcagtagttcagaaacactgtttttgtagaatctgcaaagggctatttgggagcacattgtggcataagctggaaaagaagatatattcagataaaatctagaaagaatctttctgagaacctgctttgtgatgtctgcattcaactcaaagaggtaaaactatcttttgattcagcaatttggagacactgtttttgttcattctgtgaaagtacatttggcagctcattgttgccaatggtgaaaaattgaatataccaggataaaaactagaatgaagctatctgagaaacctctttgtgatgtgtgcattcatctcacatagttaaatcttccttttgattcagtagtttggaaacactgtatttgtccattctgcacatggacattttggagcccattgatgtttaatgcaaaaagtgaatatcccaggataaaaaagaaggaagctatcagagtaaaagcttagagacatgtgccttcatctcacaaagtgaaacctttcttttaactcagcagttttgaaactctgtttttgtccattctgtgagtagacatttgggagaccattaatgcttagcatgaaaaagcagatattccgggataaaaatgataaggaagccatctgagaaacagttttgtcatgtgtgcattcatctcaccaagttaaagctttcttttcattcagacgtttggaaacactgtttttgtagtatctgagaagaaatatttgggaacgcattgagggctatggtgaaaaacaaaatatcttcagttaaaacttgaaataagtaatgtgtgaaactgctttgttatgtgtgttttcatctcaaagagttacacttttcttttgtttcagcagtttgaaacactctttttgtaggatctgccaaggtatttttgggattgcattgaagactctggtaaaaaagaaaatatcttccaataaatagtggaaagaagcttcctcagaaactgctttgtgatgtgtgcattcatctcactgagttaaagctttgttttcattcagcagtttggaaacactgtttatttccattctgcgaatagacatttcagagctcattgatttaaatggcaaaaaagtgaatatcaaatgataaaaactacaaagaatctacctgaaaaaccactttgtgatgtgtgcattcatctcacagatttcaaagtttcttttgattcagcagtttggaaacactgtttttgtccattctaccaatgaatatttgggagctcattgaagtcactgcccaaaaaagtgaatatcctaggataaaaactagatggaagctacccgagaaaccactttgtgatgtgtgcattcatcttgcagaattaaacctttgttttcattcagcagttcgtaaacagtgtatttgtggaatctgcaaagggatatttgtgaaccactaaggtttatggtgaaaaatgaaatatcttcaagtaaaaattagaaagaagtcttctgataaactgctttgtgatgagtgcattcatctcacagagataaaactttctttgatttggtagtttggaaacactgtttttgtgctttctgtgaatggacaattgggaactcattgaggacaatggggaaaaagggaatatcccaagataaaaactagaaggaaggtatttgagaaactgctttgtgatttgtacattcatctcgcagagttaaacctttcttctcattctgcagtttggaaacaactttttttgtagaatctggaaagggagatttgggagcgcttttaggcctttgttgaaaaaggaagtacctgcagatagaaaatagtaagaagatttctgagaaactgctttgtgacgtgtgcattcaactaaccaatttaaaactatttttggattcagcagtttggaaacactgtttttgtccattctgtaaatggacatttgggagctcatggaggccaatgggagaaaagtgaatattccatgataagccatctgagaaactgctttgtgatgtgggcattgatctcgcatatttaagccattcttttcattcagcagtttggaaacactgtttttatagaatctgccaagggatatttgggagtgcattgaggcctatagtgataaaggaaacatctaatgataaaaactcacaggaagttttctaagaaactgctttgagatgtgcgcattcatctcaaagagttatacacttctttggattcatcaggttggaaatactgtttttgttcatcctctgagtgaacttttgggagctctttgaggccaatttcaaaaaagtgtataaaaagtagaaggaaactctctgaggaaatgccttatgatgagtgcatttatcttccaagtttacacttttctttatattcagcagtttggaaacactgtttttgtagaatctgcgaagggatatttgggagttcattgaggcctatggtgaaaaagtaaatatcttcatataaaaactagcaagaagcattctcccaaactgctttgtgatgtgtattcatctcactgtgttaaaactttctttggattcagcagtttttaaacactgatattgtccattctgtgaatggacatttgggagctgattgaggccaatggggaaaaagtgaatatcccaggataaaaagtagaaggaagctgtctgagaaactgctttgtgatgtgtgtattcatctggaagagttaaactttcgttctctttcagctgtttgggaacaatttttttgtagtatctgcgaagggctattggggagcactttggggcctatggtgaaaaagtgaatgctttcagataaaaactagaaagaagctttatgagaaactgctctgtgttgtttgcatttgtctcacagaattaaaactatctttggattcagcagtttcaaacagtgtttttgtctgttctgtgaatggacagttgggagctcattgaggccaatggtgataaagtgaatatcccagtataaaaactagaaggaagctatcagagaaaatgctttctgatgtgtgtattctactcaaagagttaaaccttagttttctttcagcagtttggaaacaatgtttttgcagaatctgagaaggtatgtttagaagtgcattgaagcctatggcgaaaaaggaaatatcttgagataaaaactagaaaggagttttctgagaaactgcattcggatgtttgcactcatctcacagagttaaactttctatggattcaacagtttggaaacacagtttttgtctcttctgcgaatgaacattttgaagctcattgaggttaattgcgaaaaagtgaatatcccatgataaaaactacaaggaagctatttgagaaatcggtttgtgttgtgtgccttcatctcacagagttaaacttgtcgtttcattcagccctttggaaactctgttttttagaatgtatgaaggaatatttcagagggctttgaggccaattgtgcatagggaaatatcttcagataaaaacgtcagaaaaaccagaaagaagcatttgagaaacagctttgtaacgtttccactcaacacacagggttaaaactctctttgaatttagtagtttggagacactttgtttgtagtatctgtgaagcactatttgggagctctttgaggccaaaggaaaaaaagtgaatatcccagggtaaatactagaaggaagctatctgagaaaccactttgtgatgtgtgcattcatctcacagacttacttgtcttttcattcagcagtttggaaacactgttttgagaatctgcaaaggaatatttgggagcactttcaggtctatgggaataaaggaaatattttcagataaaaattagaaagaagctttctgagaaactgctttgtgatatgtgtattcatctcacagtgttaaagctttctttttattcagcagtttggaaactctgtttttgtccattctgtgaatggacattcggaagttgattgaggccaatggcaaaaaagtgaatatcctaggataaaaacaagaaacaagaggaagctatatgagaaagtgctttgtgttgtgtgcattcatcttgcacagttaaaccttacttttcattcagctgtttggaaacactgttttcatagaatctgcgaagggatatttgggagcacatagaggcctatggtgaaaaaagaaatatcttcaaataaaaactagaaagaatctttctgacaaactgctttgtgatgtgtgcatccgtcttacacagttaaacctttctttggaatcagtagattggaaacactgtttttgtagaatctgcaaaggggtttgttgtagctctttgaggccaattgtgaaaaagtgaatatcccaagataaaaagtagaaggaagctatctgacaaaccactttggatgtgtgaattcatctctcagagttaaacatttctcttaattcagcagtttggaaactcattttgtagaatctgtgaaggaacatatgggagtgcattgaggactaggctgaaaaaagaaatatcttcagataaaatctagaaagaagggttctgagaaactgctttgtgatgtgtgcattcatctcacagagttaaacctttctttgtattcagcatattggaaatgctgtgtttgtaaaatctgcaaagggatatttgggagctcattcatgatacaggcgtaaaaaaatatcccaggctaaaaactacaaggaagcaatctgagaaactgctttgtgatgtgtacattgatcaatcggagttaaaccttctcctcattcagcagtttggaaacactgtttttgtaggatctcagaaggcatatttgggagagcattgaggcctatggttaaaaaggaaatacctccagataaaaatgagaaagaagctttctgagaaattgttttgttgtatgtgcactcatctcacagagttaaatctttctttggattcagcatttttggaaacactgtttttctccattttgcaaatggacatttgggatctaatttaggccaaaggcaaaaaaagcgtgtatcccaagataaaaattagaaggaagatatctgaccaactgctttgtgatgtgtgcattcatctcacagagttaaacttttcattcagctttttgaaaaaaactgtcttggtaggaactgcgaagggatatttgggagtgcattgaggcctaaggtgaaaaagcaaatatcttcaaataaattctagaaagaagttttcttggaaactgctttttgatgtgtgcattcatctcacacaggtaaactgttctatggattcagcagtttggagacactgttttggtagaatctgtgaagggatatttgggagtgcattgagggttgaggtgtaaaaggaaatgtcttaagataaaaactagaaagaaggtttctgagaaacaaccttctgatgtttgcattcatctcacagagttaaaactttctctggattcagcagtttggaaacgctgtttttatccattcacggaagggaagatttggagctcattgaggaaagtggcaaaaaggtgaatgtcccaggataaaaacaaaatgaatgcacatataacaaggcagtttctcagatagctttattcttctttttattttgggatattgcttattcgccattggcctgaaggaactccaaaaatgtccgttggtagagtggacaaaaacagtgtttccaaggtgctgaatccaaagaaaggtttaagtctgtgcaatgaatggacacatcacaaagctgtttctcagaaaatttcttcctagtttttaatctgaagatatttcctttttcaccataagcctcaaagtgctcccaaatatccctttacagatcccaccaaaacagtgtttccaaactgctgaataaaaacaaaagtttaactctgcattttgaatgcaaacatcacaaagctgtttctcggaaaacttctttctaatttttatctgaagatgtttcctttttcaccataagcctcaatgcactcccaaatatcccttcacagattctgccaaaacagtgtttgcagacagctgcatgaaaataaagatttaactctgcgaggtgaatgcacacatcacagaacgatttcagagagctgtcttccaaatttatcctgggatattttctttttcaccattggcctcaatgagctcccaaaatatccatttgcagaacggacaaaagcagtgtttccaaatagctgaatccaaagtaatgtttacttctcttaggtgaatgtgcacatcacaaagccatttctgagaaagcttctttctagtttttatcagtagatatttcctttttcaccatagacctcaatgcactcccagatatccctttggattctaccaaaacagagtttacaaactgctgaatgaaaagaatggtttacctctgtgggatgaatgcacacatcaaaaagtggtttctcaaagagcttccttctagtttatatcctggtatgttcacttttttgccattggcctcaatgagtttccaaatgtctattttcagaatggacaaaaccagtgtttgcacactgctgaattcactgaaatatttaactctgtgagatgaatgcacacataaaagaaaacaattctcagaaagcttctttctagtttttatctgaagatatttcccttttcaccttaggcctcaaagtgctctcaaatataacatcacagattctacaaaaacagtgtaaacataatgataaataaaaagaattttttaaagcttagaggtgaatgcacacatctcaaagcagtttctcagataacttccttctagttttttttcctaggatattcactttttcgaatttggcctcaatgagctcccaaacatcccttcacagattctacaacaactgttttcctaaactgctgcatccacagaaaggttaaactctgtcagctgaatgtacacatcacaaagtagtttctcagaaatctttctagtttctatctgaagatatttcctttttcacccaaggcttcaatgtgctccaaaatatccttttgtggattctgccaaaacagtgtttccagactgctgaatgacaggaaagatttacagctgcgaggtgaatgcacacatcacaaagtgacttctttatatcttccttctagtttttatcctgggatattcccttttactacattggcctcaatgagctcccaaatgtccattcacagaatggacaaaaacagtgtttgcaaactcttgaatccacagaaagttttacctctgtgagatgaatgcacacatcacaatgcagtttctcagaatgcttctttttagtttttatctgaagatgtttcctttttcactattggcctcaatgtgctccaaattatgacatcacagattctacaaaaacagtgtttccaaactgctgaatgaatggaaatgtttaactctgtgagaagaatgcacacatcacaaagctgtctcttaaatggcttccttctcgtttttatcctgggataatcactttttctcccttggcctccatgagctcccaaatatcccttcacaaattctacaaaaacagtggttccaaactgctgaattaaaagaaatgtttaactctgtgaggtgaatgcacacacacaaatctgtttctcaaatagcttccttttggtttttatcctggaatatttgctttttcaccattggctgaagccaaatgagcccccaaatatccatttgcagaaaggacaaaaagagtttatgcaaactgctgcatccacagaaatgttcatctcagtgagatgaatgcacacatcacaaagcagtttctcattaagtttctttctagtttatatctgaaggtatttcctttttcatcttatgcctcaatgtgatcccaattataacttcacagatactacaaaaacagtgtttacaaactgctgaatgaaaggaagggtttatctctgagagatgaatccacacatcacaaagcagtttctcagataggttccttctagttcttttctggggatattttctttttcacctttggcctcagtgagctcccaaatatcccttcgcaaattccacaacaacagtgtttccaaacttctgaatccaaagacatgtttcactctgtcagctgaatgcatacatcacaatgtagtttattggaatgcttctttctagtttctatgtgaatatatttactttttcaccctagacctcaatgcactcccaaatatcccattgtggattcccccaaaacattgtttccagactactgaatgaaaacaaagtttatctctgcgaggtacatgcacacgtcacaaagcagtttctgagatatcttcattccagtttttatcctcggatattcagtttttcgccactggcctcaatgagctcccaaatgtacactcacagaatggacaaaagcagtgtttgcaaactgctgaatccagaaaaatgtttaactttgtgagatgaatggacacatcacaaagcagtttctcagaaagcttctttctagtttctgtctgaagatgtttcctttttcaccataagcttcagtgcgctcccaaatatcccttcacagtttctatgaatacagtttttgcaaattgttgaatgaaaagaaaggcttaactctgtgagatgaatgcttacatcacaaagcagtttctcagacgtcttccttctagtttttatctggggtattcattttttcaccattggcctcaatgagctcccaaatgtccatttgcagaatggacaaaaacgtgtttccaaactgctgaatcaaaagaatgttttaactctgttaggggaaagcacacttctcaaagcaggttcttagaaaacttctttctagtttttaacttcatatgttaactttttcaccttaggcctctatgcactcccaaatatctctttgcagattctacaaaaacagtgtgtccaaactgctgaatggaaagaaaggtttaactctgtgaggtcaatgcacacatcacaaagcactttctccaatagcttctttctactttttatcctgggatattcgctttatcaccattggcctaagtgggctccaacatgtgcattcgcaaaatggacaaaaactgtgtttccaaactgctgaataaaagaatggtttaactctgtgagatgaatacacacatcacaaagaagattctcagaaaaattctttcttttttatctaaaatttatttttcaccattggcgagaatgcacccccaaatattgcttcgcagattctacaaaatcagtgcttagaacctgctgaaggaaaagtgaggtttaattctgtgagatgaatgtgcacatcacaaagcagtttttcagataccttccttctagtttttattcctggatattcggttttttgccaatggcctcaataatctcctgaatgaatatttgtagaatggacaaaagcagtgtttccaaactgctgagtcaaaagaaaggtttaactctgtgagatgaatgcacatatcacaatgtagtttctcaaaaagcttctatctagtttttatctgaagatatttcctttttcaacatagtcctcaaagcactcccaaatatacctttgcagattctacaaaaatagtgttttcaaactactgaaagaaatcaaatttttaactctgtgagataaatgcacacatcacaaagtggtttctccagtagcttcctagtagtttttttcttgggatatttgcttttatgtcataggcctcaatgagctgccaaatatcctttcacagaatagacaataagagtgtttccagacagctgattccaagaaaggcttaaatctttcttggaaaatgaaatgaaatgaatgaatgaaatgaatgcacacctccaaagcagtttctcagaaagcttcttacttgtttttatctgaagatattttccctttcaatgtaagcctcaatgcgctcccatatatccctttgcagattctacaaaaacagagtttccaaactcctgaatgaaaacaaaggttttactctatgagatgaatgcatacatcacaaagcagtttatcagagagcttccttctagtttttatcctgggatatttgtttttttgccattggtctcaaagatctcccaaatatccactcacagaatggacacaaacagtgtttccaaactgctgaatcataagacagttttaactctgtgagatggtggcacacataacaaggttgttactaagacagctttcttccagtttttatcctgggatattagctttttgccattggcctcaataagctcccaaatgttcattcacagaattgagaaaaaaggtgtttccaaagtgttgaatcaaaagaaaactttaaccctgtgagaagattgttcacactgaaagcagtttttcagaaagcttctttctagtttttatctgaatatattttctttttcactctaggtctccatgtgctctcaaatatccctttgcagattctccacaaacagtttttccaaactgctgaatgaaaaggaaagtttaattttgagagatgaatgctcacatcaaaaagcagttattcagatagctttcttctaatttttatcctgggagattccattttttgccatttgcctcaatgagctcctaaatgtccatttgcagaatggaaaaaaaaacagtgtttccaaactgctgaatcaaaagaaaggtttaactctgtgagatgaatgcacacatcacaaagcactttctgagaaagcttattttcactttttattggaagataatttctttttcaccatagtcctcaatgcactcccaaacatccctttgcaaattctacaaaaagaatgtttccaaattgctgaatcaaaagaaaggtttaactcgatgagatgaaggcacatatttcaaagtggtttctcagattgcttccttatactttttatcctggaatatttgctttttcacccttggcattgatgatctccaaaatgtccattggcagaacggacaaaaaaggactttcaaaactgctgaattaaaagaaaggattggctctgtgagatgaaggcacatctcacaaagcttttactcagatagcttccttctttttaatccttggatattcactttttgcattaaacctcaatgcactcccgaatgtccatgtgcagaatggacaaacacagtgtttccaaactgctgaatcaaaaggaaggtttaactatgtgagacaaataccacatcacaaagaggttcctcagatagattccttctagattttatcctggtatattcgattttttgcctttggcctaaatgatttgccaaaagtccttttgcagaatgaataaaaacagtgtttccaagttgctgaatcaaaagaaacctttaaccctttgagatgaatacaaacatcataaagcagtttctcagaaagattctttctagtttttatctgaagatattttctttttcaccttatgcctcaatgtgttcccaaatatccctttgcagattctacaaaaagagtgtttccaaactgctgaatgaaaagaaagtttgtctcttcaaggtgaatgctcacatcagaaagcagtttcacagagagctttttactagcttttatcctgggatattcacagtttccgagaaactgctttgtgatgtgtgcattcatctcacagaattaaaaccttcttttgattcagcagttttgaaacactgtttttgtcctttccgcgaatgaacatttgggagtttattgaggtcaatagtgaaaaatcgaatatcccaggataaaaactagaagaaagccatctaagaaactgctttctgatgtgtgcattcatctgcaaagtttacctttctcttctttcaccagtttggaaacactgcttttgtagaatctgtgacgtgatattcgagagctcattgaggcttaggatgaaaaagaaattatcttcagataagaactagaaagaagctttctgagaaactgcttcatgatgtgcgcattcatctcacagagtttaacatttctttggattcagccgtttagaaacaagggttttatccactctttgtaaggacatttgggagcccactgaggacaatgatgtaaaactgaataaactgggtaaaactagaaggaatctatctgagaaacctatttgtaatgtgtccattcaagtcacggacttaaacctttcttttcattcaacagtttggaaaaactttttttataggatctgtgaagtcatattttggagtgcattgaggactatagtgaaaagaaattatcttctgataaaaaatagaaagaaactttctgagaaactgctttgtgatgtgtgcattcatctcacctaggtaaaactttcttctcattcagcagattggaaacactcttttttgtagaatctgtgaggggatatttcggtgctttgaagtcaatggttaaaaaggaaatttcttcagatagaaacaagaaagaagctttctgaggaactgctttgtgatgtgtgcattcatctcagagttcatcctttcttttgatacagcagtttggaaacactgtttctgtggtgaaaaagaaaatatcttcagaaaaaaactacaaagaagatttctgagaaactgctttatgatatgtgcatatatctcacagaggtaaacttttcttttgattcattgtttataaaatctttgttttttcattctgcaaatttacatttgggagctcattgagaccaatggtgaaaatgggaacgttccaggataaaaacaagaaggaagctacctgaagaactgctttgtcatacgtgcattcatctcacagagctaaacttttctttgactcaacatttttgaaacactgtttttgaagcatctgccaagggatatttggtagttcattgaggccaagtggtaaaagagcaaatattttcagataaaaaataaaaagaaacattctgagaaactgctttgtgatgtgtgcattcatcttacaaacttaaaactttctttggattcagcagaagtttcgaaacactgtctttgtccattttgtgaatggacatttgggagctaactgaagccaaggggaaaaaaggcaatacaccagtataaaaactagaaggaagctatctgagaaactactttgtaaagtgtgcattcatctagcagagttaaacatttcttttcattcaacagcttggaaacactgtttttggagaatatgcgaagcgatatttgggagcgcattggggcctatggtgaaaatggaaacatcttcagataaaaacgggaaagaagctttcttagaaactgctttgtgatgtgtgcattcatctcacagagttaaaactttttttttgattcagccgtttgaaaacactgtttttgtccattctgcaaatggacatttgggagctcattgaggagaatggtgaaaaagcaagtatcccagaataaaaagtaaaaggaagctacctaaaaagccgttttgagatgtgtgcattaatctcacagttaaccctttcttttcattaaccagtttggaaacactgttttcgtataatctgtgaaggcatatttaagagtgtattgaggcctatggtgaaaaactaaacatcttcagacaaaagctagaaagaggctttctgacaaactcctttgtgatgtgtgcattcatctcacaaagttaaatttttctttggattcagcagtttggaaactctgtttctgtccatactgtgaaccaacaattctgaactcactgaggccaatgatgaaaagtgaatattccaggataaaacctaggaggcagctatcagagaaactgctttgtgatgtgtgcattcatctcacagagttaaacctttcttttcattcagcagtttggaaacactgattttgtacaatctgcagaggaatattttggagtgcatttaggcctgtggtgaaaaaggaaacatcttcagacaaaaactagcaagaagctttctgagaaactgctttgtgatgtgtgcattcatctcactgtgataaaattttcttttaattcagccatttggaaatactctttttgtccattttgcgaatggaaatttgggagctcactgagggcaattgtgaaaaagcaattatccccagataaaaactagaaggaagttatttgacaaactgttttgtgatgtgtgtgttcaatgaagagagagaaaattttcttttcattcagcagttcagaaacactgtttttgtagaaactgtgaaggaatatttgtgagtgcattgaggcatgtggtaaaaaaggaatcatcttcagataaaaactagaaagaggttttctgagaaactgttttgtgatgttgcattcatctcacaaagttaaaattttctttggattcagcagttttgaaacactgttattgtccattctgcaaatgtactcttgggaactaattgaggccaatggctagaaagtaaatatcccaggataaaaactagaaggaaggaatcagagaaaatgctttgtgatgcatgcattcatctcacagaggtaaacttttcttttcattgaacagtttggaaacactgtttttgaagaatctgtgaaggaatatttgggaacgcattgatgcctatggtgaaaaaggaaacatcttcagaaaaaaataagaaaagttttctgagaagcttctttttgatgtgtgcattcatctcagagatttaaacttttctatggattttgcagtgtggaaacactgtttttgtccattctgtgaatggacattttggagctcattgatgccaatagcaaaaaagcgaatatcccaggttaaaatctagcaggaacctatctggggaaccatcttgtgatgtgtgcatttgttactcagttaaaactttcttttcattcagcagtttggaaacactgcttttgtggaatgtacgaagggatattaatgagccctttgaggcctattgtgaaaaaggaatcatcttcagataaaaactagaacgaagctctatgaggaactgctttgtgatgtgtgcattcatctcacagaggtgaaactttctttggattcagcagtttggaaacaatatttttgtacattctgagaatggacttttgggaactctttgaggccaatggcaagaaagtgaatctcccaggattaaaactaaaaggaagctttctgagaaacggctttgagatgtgttcattcatctcgcagagttaaacttttcttttcattcaggagcttggaaacactgtttttgtagaatctgtgaagaggtattttgtagtgctttgaggcttatggtgaaaaaggaaacaagataaaaaaatagaaagaagctttctgagaaactactttgtgatgtgtacattcatctcacagttaaaagtttccttgaatttttcaatttggaaacattgtttttatctgtattgtgaatggacatttgcaggctcattgaggccaatggcaaatgagtgaatatcccaggataaaaactagaagacagctacctgaggaaccactttgtgatgtgtgcattcttctagcagaggtaaacctttcttttcattcagcagtttggaaacactgtttttgtagtatctacaaagtgatatttgggagtgcattgaggcctatggtgaaaaaagaaatatcttcagatgaaaacaagaaagaaggtttctgagaaactgctgtggatgtgggcattaatctcacagatttaaatctttctttggattctgcagtttggaaacactgtttttgtcctttcagcaaatggatgtttggaagctcattgaggccaatggtgaaaaagggaatatcctaggattatcactacagtgaagatatctgagaaaccagtttgtcacgtttacactcatcttgcagagttaaaccttttcattcatcagtttgcaatgctgctttggtagaatctgcaaagggatatttggtagtgcattaaggtctatggtcaaaatgtaaatatcttcaaataaaaaatagaaagaagctttctgagaaactgccttgtgatgtgtgcattcatctcacagaggtaaagctttctttgaattcaggagtttggaaacactgtttttgtggaatttttgaaaagatatttgtgagcactttgaggcctatggtgaaaacgaaaacatcttcagataaaaactaggaagaagcttaatgagtaactgcattgtgatgtgtttattcatccaatagagttaagcctttctttggattcagtggtttcgtaacacagtttttgtccattctgtgaatggagtttgggagctcattgaagccagtgcattcatctaacagagttaaacctttcttttcattcagcagactggaatcactgtttttgtagaatctgctaattgatatttgggagcacattcaggcatatggtgaaaaaggaaatatcttcaaataaaaagtttaaagaaattttccgaaaaactgctttgtgatgtgtgcattcatctcacgcagttaagcctttcctgggattcagcaatttggaaacactgtttttgtagaatctgtaaaggaatattttggaggtcatagggaccaattgcaaaagagataatatccaagaataaaaactagaaagaagctatttgagaaactgctttgtgatgtgtgcattcatctcacagtgttaagcctatcttttctttcagaaattggaaacactgttttggtagaaactgtgaatgtattatagggagcacattgaggccaatggtgaaaaagaataatcttcagataaaactggaaagaagctttatgagaaactgctttatgatgtgtacattcatctcacagagttaaacctttgtttaaattcagcagtttggcaacactgtttatgaagaatctgctaagggatatttgatagtttaatgaggccaaaggcaaaaaagtgaatagtacagcataaatactagtaggaagctacctgagaaaccactttgtgatatgtgcaatcatttcacagaattaaaactttcttttcaattcaacagcttggaaacacagttttggtagaatctgtgaggggatatttgacagcccatggaggcgtatgatgaaaaaggaaatatcttcagataaatactagaaagaaactctctgacaaactgctttgtgatgtgtgcattcatctcacagagtttaaactttcttgggattcagcacattggaaaaactgtttatgtacaatctgtgaaagcatatttgatagctcattaaggccaatactaaaaagcaaatatctcaggataaaaactagaaggaagctattggagaaactgctttgtggtgtgtgcattcatctcacagagttaaaccttttttttcattcagcagcttggaaacgctattttggtataaactgcaaaggtatgtttgggagtgcattgaggcctacagtgaaaaaggaaatatctccagataaaaactagaagaatctttctgagaaactgatttgtgatgtgtgcattcatctcacagctttaaacctttcattggatttagcagtttggaaacactgttttgtccattctgcaaatggacatttgggagctcattgtggccaatggtgaaaaagtgaatatccaagaataaaaactagaaggaagctatctgagaaaccactttctgatgtctgcattcatcttgcgagttaaaactttcctttcattcaacagtttggaaaaaaattagaagctttctgataaactgctttgtgatgtgtgtattcatgtcacagaattaaacctttcttttcattcagcaatttggaaacactgtttttgtagaatctgtgaagggatattttggagcgcattgaggcctatggtgaaaaagtaagtatcttcagataataattagaaagtaattttctgagaaactgctttgtgatgagtgcattaacctcacagagttgaaactttctttggattcagcagttgggaaacactctttttgtacattctgtgaaaggacatttgggaagtcatttaggccaatggctaaaaagcaaatatcccaggataaaaactagaagaaagataggtgagaaactgctttgtgacgtatgcattcacctcacagattcaaacctttcttttcattcagcaatttgaaaacactgttttggtagaatctgggaagggatgtttgggaatgcattgaggcctatgaaaaaaaaggaaatatctccagataaaaactagaaagaagctttctgagaaacttctttttaatgtgtgcattcatctcacagagttaaacttttccttggattcagcagttttgaatcaatgtttttctccattctatgaatgtacattttggagctcattgagaccaaaggcggaaaagcaaatatccaaggataaaaactagaagaaagctatctgagaaacaaaacagtttctcagaaagcttctttctagtttttatctgaaaatattacctattttttataggcctcaatgtgctccccaatatcccttcacagattcttccaaaacaaattttccaaatggctgaaagaaaagaaaagtttatctgtgtgtgcgctcccatgtataccttcatggattctaccaaaacagtgtttccaaactgctgaatgaaaagaaatgtttaactctgcgagatgaatgcacacataataaagcagtttctcagataacttcctgcttcttttatcctgtgatattcactttttcaccatggcctcaatgagttcccaaatgtccattcgttgaatggacaaaaacagtgttaacacactgctgaatacaaagaatggtttaactctgcaaggtgactgaacacattacaaagcagtttctcggaaagcttctttctagtttttatctgaatatatttcctttttcaccatagacctcaatatactcccaaatatctcttcacagattctacaaaaacagtgtttccaaactgctgaatgaaaggaatggtttaacttgcgagatgaatggatacatcacaaagcggtttctcaaatagcttccttccagtttttaccctgggatattcactttttcgccattggtttaaatgagcttccaaatgtccattctcagaagggacaaaaacagtgtttccaaaccgccgatttcaaagaaaggttttactctgtgagatgaaggcactcatcacaaagcagtttctcagaaagtttctttcaagtttgtacctgaacatatttcctttttcaccataggtcaaaatgtgctcccaaatatccctttgcaggttctacaaaaacagtgtttccaaactgctgaatccaaaaaacattttacctctgcaaaatgaatgtatacatcactaagcagtttctcagatatcttccttctagtgcttatcctgggatattcactttttcaccactggcctcaatgagctcccaaatgtccttgttcagaattgacaaaaacagtgtttccaaactgctgaatccaaagaatggtttaagtctgtgagatgtatgcagacaccagaaagcaatttctcagaatgattctttctacttttttttaattatgctttctttaagttttagggtacatgtgcacaacgtgcaggttagttaaatatgtatacatgtgcatatgtaaaagaaaggtttaattctgtgagatgaatgcacacatcgccaagtggtttctcagatatcttccttctagtttttatcctgagatagttgctttgttgccattggcttcaataagctcccaaatgtccatttgcagaatggacaaaaacaatgtttccaagttgctgaatccaaataaaagtttaaataggtgagatgaatgcacacatcacaaagcagtttattggaaaagttctttctagttttcatctgaagatatttcctttgtcaccataggcctgaatgctctgctgaatattgcctcacagattctaacagaacagtgtttccaaactgctgaatgaaaaatagattcaactctgtgaggtgaatgtagacatcacaaggccatttctcaggtactttccttctagtttttatcatgagataatcattttttcctttaaggactgaatgagctatcaaatatgctttcacagattatacaaaagcagtgtttccaaactactgaatccaaagaaaggtttaactctgttagatgaatgcacacaacagaaagtattttctcagataatttctttctagttttcatccgaagatattttgtttttcaccataggcctcaatgcactctgaaatatccctatgcagcccctattaaaagagtgcttccaaactgttgaatgaaaagaaatgtttaactctgtgagatgaatgcacgtatcaccaagcaccttctcagatcttctgtctcgtttttatcgtgagatattcactttttagcctatggcctcaaagatctatcaaatatctctttgcagtttctataaaaacagtgtttccaagctgctcaatccaaagaaaagtttaactctgcaagatgaatgcatacatcacaaagcagtttctcagaaagctgctttctagtttttatctgaagatatttcctttttcaacataggtctcaatccactcccaaatgtcccttggcaaattgtaccaaaacagtgtttccacattgctcaatggaaggaaaggtttaactctgagagatgaatgcacacatcacaaagcggtttttcatttagctttcttctaacgtttatcctgagatagtcactttttcacctttggactcaatgagctcccatatgtccattcgcagaatggacaaaaatgttgtttccaaactgctgaatgaaaagaaagttttacatctgtgagatgaatgcacacttcacaaagcggtttttcagatatcttccttcaagtttttatcctgggatgtttgctgtttcaatttggcctcaatgagctccaaaataccactttgcagatcctacaaaaagagtggttcctaatgactgaatgcaaagaaatgtttaaatctgtgacataaatgtacacatcacaaaggagtttctcagaaagatttttcgagttttcatctgaaggtatttcttttttcactgtaagtctcattgcactaacaaatatcccttcgcagattctaccaaaccattgtttccaaactgctgaatgaaaagaaatttttatctctctgagatgaaagcacccatcacaaatcgttttctctgttttctcagatagcttccttatagtttttatcctgggatatttgctctctctcctatggccacaaggagctatcgaatatcccttcacagattctgcaaaaaccgtgtttccaaactgctgtatcccaagaaatgtgtaactctgtgagacgaatgcatacatctcacagtttctcagtaagcttctttctagttttttctgaaggtatttcctttttcaacctaggtctcaatgcgctcccaaatatcccttcacagatctcacaaagtcagtgtttccaaactactgaacacaaagaaaggtttaaatctgtgagatgaatgcacaaatcacaaagtagtttctggaaagcttttttctaattttcatctgaagatatttcctttttcaccataggcttcaatgcgctcccaaatatcccttcgtggattctaccaaaacagtgtttccaaactgctgaatgaaaagaaagttttaactctttaagatgaatgcacacactacaatgggtttctcagatagttttcttctagtttttatcatgggatattgactttttcgccatttgccacaatgagtttccaaatgtccatttgcagaatggacaaaaacagtttttccaaactgctgaatccaaggaaaagtttaaatgtgtgaggtgaatgagcacatcacaaagcagtttgtcagaaagcttctttctagtttttatctgaagatgttttctttttcaacctaggcctcaatgtactcccaaatacccctccacagatccctcaaaataaatgtttacaaactactgaacacaaagaaagttttaagtctgtgagatgaatgaacacatcacaaagtagtttcttagaaagtttttttctagttttcatctgaagatatttcctttttccccataggccttaatgcactcccaaatatcccttcatggattctaacaaaagagtttttgcaaagtgcagaatccagagaaaggtttaactctgtcagatcaatgcactcatcaaaaggcggtttctaaaagagcttccatccagtttttatcctctgatatgtgcttttttgcatttggccacaaagagctccaaaatgtacatatttaattctgtgagatgaatgcacacatcacaaagcagtttctcagaaagcttctttctaatttttatctgaagatatttcctttttcacagtaggcctcaatgagctcccaaatatccctttgcagattctaccaagacagtgtttccatactgctgaaagaaaaggaagatttaactctgagagatgaatgcacagctcacaaggcggttttccagataccttcttattgatttttatcctaggatattcactttttactatatggcctaaaagagttcccaaatatccctttgcagattctagaacaacagtatttccaaactgctgaatccagtgaaaggtttaactctctgagatgaacacacacatcacaaagctgtttgtcagaaagctactttccatgtttacctgaagatatttcctttttaaccataggcctcaaagtgctcccaaatatcccttcacagattctactgcaacactatttccatactgttgaatgaaaggaaagattgaaatattcgagatgaatgcacacatcagaaaacagtttctcagatatattctttctagtttttatccaggtatattcctgttttccccttcatcctcaatgagctttcaaatatccctttgcaaattctgcaaaaacagtgtttacaaactgctgaatccaaagagtggtttaactctggagatgaagaacacaccacaaagtatttctctgaaagcttctttctagtttttatctgaacatgtttccttttttaacataggcctcagtgcactcccaaatatccctttggagattctacaaaaagagtgtttccaaactgctgaatgcgaagaaagtgttatacctgaaacatgaaggcacacatgacaaagtggtttctcagatatcttcctatgagtttttatccagggatatttgctttttctcctatgaactcaatgaactcccaaatatctcttcacagattctccaaaaacattgcttctaaactactgaatccaaagaaacatttaattgtgtgagctgaatgcacacatcacaaagcactttctcagaaagtttccttccagtttttagctgaatatatttcctttttcaccgtaggcctcaatgcgctcccaaatatcaagtcgcagattcttcaaaaacactgtttccaaactcttgaattaaaagaaaggtttaactgtgccagatgaatgcatactccacaaagcagtttctcagagagattccttctaatttttatcctgggatattcacttttttgcttttagactcaatgatctcccaaataacttcatggattctacaaaaacagagattccaaactgctgaatccaaagaaaggtttaactctgtgagatgaatggacacaacacaaagcagtttctccgaaaacttctttctaatttttatctgaagatattttctttttcaacataggcctcaatttactcccaaatatcctttgtggattctaccaaaacagtgtttaaaactactgaatgaaatgaaagttttaactctgtgaggtgaatacacacatcacaaatcggtttctcagatagcttcattcttatttaatcctgggatatacgctttttcaccattggcataattgagctcacaaatgtccattcccagaatgaacaaaaacagtgtttcccgtgatgaatccaaagaaaggtttaactctttgagatgaatgtacacatcacaaagcagtttcactgagagcttaaatctagattttatcctcacatatttgcttttttggatttggcctcaatgaactcccaaataccccttttcagcttctacaaaaacagtatttccaaactgctgaatacaaagaaagttttaactctatcagaaaacggaacacatcacatagcagtttcccagaaagctgctttctagtatttatctgaagatatttcctttttgaccataagcctcacaactctcccaaatatcccttcacaaattctgccaaaacagagtttccaaactgctgaaagagaagaaaagtttaactgtgcaagatgaatacacatatcacaatatggtttctcagatagctgccttctagtttttatcctgggatattcactttttctcaattgaccacaacgaggtcccaagtgtccattcatggaatggacaaaaactgtgtttccaaactgctgaataaaagaaaattttaactctttgagatgaaggcactcataacaaagtagtttctcagaaagttccttcaagttttttccttgagatatttcctttatcaccataggcctcaacgtgctccaaactatccccatgcagtttctaccaaaacagtgtttccaaactgcagaatgaaaagaaaggtttaggggtggcagccaagatgaccaaataggaaaagttccagtctacagctcccagcatgagtgacgcagaagatgggtgatttctgcatttccatctgaggtactgggtttatcacactagggagtgccagacagtgggcgcaggacagtgggtgcagcgcaccgtgcatgagccaaaacagggaaaggcattgcctccctcaggaagcacaaggggtcagggagttccctttcctactcaaagaaaggggtgacagacggcacctggaaaatcgggtcactcccaccctaatactgcgcttttctgacgggcttcaaaaatggcgcaccaggagattatatcccgcacatggctcagagggtcctatgcccacggagtgtcactgatcactagcacagcagtctgagatgaaactgcaaggtagcagcgaggcttggggaggggcgcccaccattgcccaggcttgcttaggtaaacaaagcagctgggaagcatgaactgggtggagactaccactgctcaaggaggcatgcctgcctctgtaggctctacccctgggggcagggcacagacaaacaaaaagacatcagtaacctctgcagacttaaatgtctctgtctgacagctttgaagagagcagtggttctcccagcatgcagctggagatctgagaatgggcagactgcctcctcaagtgggtccctgacccctgacccccgagcagtctaactgggaggtaccacccagtaggggcagactgacacctcacagggccaggtactcctctgagacaaaacttccagaggaatgatcaggcagcaacaatcgccgttcacaaaaatccgctgttctgcagccactgctgctgatacccaggaaaacagggtctggagtgaacctctagcaaactccaacagacctgcagctgagggtcctgtctgttagaaggaaaactaaaaaacagaaaggacatccacaccaaaaacccatctgtacatcaccatcaccaaagaccaaaagtagacaaaaccacaaagatggggaaaaaacagagcagaaaaactggaaattctaaaaagcagagtgcctctcctcctccaaaggaatggaactctcctcctcctcatcagaaatggaacaaagctggatggagaatgacattgacgagttgagagaagaaggcttcagatgatcaaactactccaagctacaggaggaatttcaaaccaaaggcaaagaagttaaaaatttgaaaaaaatgtagtggaatgtaaaactagaataaccaatactgacaggtgcttaaaggagctgatgcagctgaaagccaaagcacaagaaatatgtgaagaatgcagaagcctcaagagccgatgtgatcaactggaagaaagggtaacagtgatggaagataaaatgaataaaatgaagcaagaagggaagtttagagaaaaaagaataaaaataaatgagcaaagcctccaagaaatatgggactatgtgaaaaaaccaaatctacgtctgattggtgtacctgaaagtgatggggagaatggaaacaagttggaaaacaccctgcacgatattatcccagagaacttcctcaatctagaaagacaggccaacattcacattcaggaaatacagagaatgccaaaaagttactcctcgagaagagcaactccaagaaacataattgtcagattccccaaagtggaaatgaaggaaaaaatgttaagggcagccagagagaaaggttgggttatccacaaagggaataccatcaaacaaacagcggatctctcagcagaaacactacacaccagaagagagtgggggccaatattcaacattcttaaagaaaagaattttcaacccagaatttcatatcgagccaaactaagcttcattagtgaaggagaaataaaatactttacagacaagcaaatgctgagagattttgtcaccaccaggcctgccctaaaagagctcctgaaggaagcactaaacatggaaaggaaaaaccagtaccagccactgaaaaatcatgccaaattgtaaagaccatcgaggataggaagaaattgcatcacctaatgagcaaaataaccagctaacatattaaggacaggatcagattcacacataacaatattaactttaaatataaatgggctaaatgctccaattaaaagacacagactggcaaattggataaagagtcaagacgcatcagtgtgctgtattcaggaaacccatctcacgtgcagagacacacataggttcacaataaaaggatggaggaagatctaccaagcaaatggaaaacaaaaaaaaggcaggggttgcaatcctagtctctgattaaacagactttaaaccaacaaagatcaaaagagacaaagaagaccattacataatggtaaagggatcaattcaacaagaagagctaactatcctaaatatgtatgcacccaatataggagcacccagattcataaagcaagtcctgagtgacctacaaagagacttagactcccacacaataataatgggagaatttaacaccccactgtcaacattagacagatcaacgagacagaaagttaacaaggatacccaggaattcaactcagctctgcaccaagcggacctaatagacatctacagaactcttcatcccaaatcaacagaatatacatttttttcagcaccacaccacacctgtttcaaaattgaccacatacttggaagtaaagcactcctcagcaaaggtaatagaatagaatttataacaaactgtctctcagagcacagtgcaatcaaactggaactcagaattaagaaactcactcaaaaccactcaactacatggaactgaacaatttgctcctgaatgactactgggtacataacgaaatgaaggcagaaataaagatgttctttgaaatcaatgagaacaaagacacaacataacagaatctctgggacacattcaaaagagtgtgtagagggaaatttacagcactaaatgcccacaagagaaagcaggaaagatccaaaattgacaccctaacatcacaattaaaagaactagaaaagcaagagcaaacacattcaaaagctaccagaagagaagcaataactaaaatcagagcagaactgaaggaaatagagacacaaaaaacccttcaaaaaattaaggaatccaggagctggtttcttgaaaagatcaacaaaattgatagactgctaacaagactaataaggaagaaaagagagaagaagcaaatagatgcaataaaaaatgagaaagaggatatcactgatatcccacagaaatacaaactaccatcagagaatactacaaacacctatatgcaaataaactagaaaacctagaagaaatggaaaaattcctagacacatacaccctcccaagactaaaccaggaagaagttgaatctatgaatagatcaataacaggctccgaaattgtggcaataatcaacagctcaccatccaaaaagagtccaggaccagatggattcacagccgaattctaccagaggtacaaggaggaactggtaccattccttctgaaattattccaatcaatagaaaaagagggaatcctccctaactcattttatggggccagcatcattctgacaccaaagcctggcagagacacaaccaaaaaagagaattttagaacaatatccttggtgaacattgatgcaaaaatcctcaataaaatactggcaaaccgaatccagcagcacataaaaaagcttatccaccatgatcaagtgggcttcatccctgggatgcaagtctggttcaatatactcaaatcaataattgtaatccagcacatatacagaaccaaagacaaaaaccacatgaatatctcaatagatgcagaaaaggcctttgacaaaattcaacaacgcttcatcctaaaaactctcaataaattaggtattgatgggatgtatctcaaaataataagagctatctatgacaaacccacagtcaatatcatactgaatgggcaagaactggaagcattccctttgaaaactggcacaagaaagggatgccatctctcaccactcctattcaacatagtgttggaagttctggccagggcaattaggcaggagaaggaaatatagggtattcaattatgaaaaaaggaattcaaattgtccctgtttgcagatgacgtgattgtatatctagaaaatcccattgtctcaggccaaaatctccttaagctgataagcaactacagcaaagtctcaggatacaaactcaatgtataaaaatcacaagcattcttatacactgataagagacagagagcaaaatcatgagtatactcccgttcacaatggcttcaaagagaataaaatacctaggaatccaacttacaagggacgtgaaggacctcttcaaggagaactacaaaccactgctcaatgacataaaagaggacaaaaaaaaatggaagaacattccatgctcatgggcaggaagaatcaatatcgtgaaaatggccatacttcccaaggtaatttatagattcagtgccatccccataaagctaccaatgactttcctcactgaattggaaaaaactactttaaagttcatatggaaccataaaagagcccgcatcaccaagtcaatcctaagcaaaaagaacaaagttggaggcatcacgctacctgacttcaaactatcctacaaggctacagtgtcctaaacagcatggtactggtacaaaaacagagatatagatcaatggaacagaacagagccctcagaaataacaccgcatatcagcaactatctaatctttgacaaacctgagaaaaacaagcaatggggaaatgattccctatttaataaatggtgctgggaaatctggctagctatatgtagaaagctgaaagtggatcctttccttacagcttatacaaaaattaattcaagatggattaaagacttaaacattagacctaaaaccataaaaaccctagaagaaaatctatgctttaccattgaggacataggcatgggcaaggacttcatgtctaaaacacaaaaagcaatggcaacaaaagccaaaattaacaaatgggatctaattaaactaaagagcttctgcacagcaaaagaaactaccttcagagtgaaaaggcaacctacagaatgggagaaaattattgtaatctactcatctgaaaaagggctaatatccagaatctacaatgaacttaaacaaatttacaagaaaaaaacaaacaaccccatcaaaaagtgggcaaaggacatgaacagacacttctcaaaagaagacagttattcagccaaaaaaacacatgaaaaaatgctcaccatcactggccatcagagaaatgcaaatcaaaaccacaatgagataccatctcacaccatttagaatgacgatcattaaaaagtcagcaaacaacaggtgctggagaggatgtggagaaataggaacacttttacactgttggtgggactgtaaactagtttaaccattgtggaagtcaatgtggcgattcctcagggatctagaactagaaatgccatttgacccagccatcccattactgggtatatacccaaaggactataaatcatgctgctataaagacacatgcacacatatgtttattgtggcattattcacaatagcaaagacttggagccagcccaaatatccaacaatgatagacttgattaagaaaatgtggcacatatacaccatggaatactaggcagccataaaaaatgatgagctcatgtcctttgtagggacatgggtgaaattggaaatcatcattctcagtaaactatcacaagaaccaaaaaccaaacaccgcatattctcactcataggttggaattgaacaatgtgaacacaaggacacaggaaggggaacatcacactctggggacggttgtggggtggggggaaggggggagggatagaattaggagatatacctaatgctaaatgatgagttaattggtgcagcacaccagagtggcacatgtatacatatgcaactaaccagcacattgtgcacatgtacccttaaacttaaagtataataataataaaataaaataaaataaaataaagaaaagaaagatttaactgtgcgagttgaatgcacacattacaaaacggtttcttacatagttttgttctagttattatcaagggatattcactttttcacctgtggcatcaattatctataaaatatcccatggtagattctccaaaaacagtgtttccaagctgctgattcaaaagaaagttttaactttgtgagatgagtgtacacatcacaacgtagtttctcagaaagcttctttctagtttttatctgaagatatttcctttctcaccatatgccgctatgcgatcccacaaatcccttcacagattctaccaaaacggtgtttccaaactgctgaatgaaaagaattgtttaagttagcgaggtgaatgcacacataacaaagcagttttgcagataacttccttctagtttttgtcctgggatattcccttttttgccattgccctgaatgagctcccaaatatccattcgcagaatggacaaaaacagtgtttgcaaactattgaatctaaagaaatgtttaagctgtgagatgactgcacacatcaaaaagcagtttctcagaaagcttctagtttttatctgaagatatttcctttttcaccataggcctcatgtagttccaaatatcccttcgcagatttttcacacacgttttttccaaactgctgaaagaaaagaaagttttagttctgcgaaatgaatgcacacatcacaaagcagtttctcagatagcttccttttagtttttatcctaggatattcgcttttagcctcaatgagctcccaaatacccctttgcagtttctacaaaacaatgtttccaaactgctgaatccaaagaaaggtttaactcggtgagatgaatacaaacatcataaagccatttctcaggaggcttctttagagtttttatgaaaaaatgtttcctttttcaccctaggcttcaatgcgctcccaaatatcccttcacagattctaccaaaactatgcttccaaactgctgaatgaaaagaaaggtttcaatctgtgagatgaaagcatacatcacaaagtggtttctcagataacttccttctagtttttatcctgggatgttcactttatcatccttggactcaatgagctccaaaatatccctttgcagattctacaaaaacaatgtttccaaactgctgaatctaaggaatgatatatctctgtgagttgaatgcacacatcacgaagcagtttctcagaaaacttccttctacttcttatgtgaaggtatttcctttttcaccataggcctcaatgtgattcccaatatctcatcgcagattctacaaacacagcgtttctaaactattgaaagaaaagaaagatttcaatttgtgaaatgaatgtacacatcacatagcagtttctgagctaccttctttctagtttgtatcctgggatattcgatttttcgcatttggcctcaatgagctcccaaatatccttttgcgtgttctataaaaacagagtttcaaaactgcttaacccaaagaaaggtctaactcagtgagacgaatcacaaagcagtttctcagaaagattcttcttagtttttatctgaagatacttcatttttcaccgtaggcctcaatgggctccctattatcacatcgcagattttaccacaagtgtgtttccaaactgctgaatgaaaataaagttttaactctgtgagatgaatgcatacatcacacagcggtttgtcagatagcttccttctagtttttgtcctggatatttgcatttttgccattggcctctatgagctcctaaaggtccatttgtagaatggacaaaaagactgtttcaagacagttgaaaccaaagaagggtttaactctgtgacatgaatgcacacattaaaagcagtttctcagaaagcttctttccagttattatctgaagatatttcctttttcaccataggcctcaatgcactcccaaatatccctttgtgctttctatcaaaacagtatatccaagctgctgaattaaaagaacggtttaattctgtgagatgagtgcacacatcacaaagcagtttcgcagagagcttccttctagtttttatcctggaatgttcacttttgctccattgtcctcaataagctcccaaatgtccattcacagaatgtacaaaacagtgtttcctaactactaaatccaaagaaaggtcgacctctgagagatgaatgcagacatcacaaagcagtttctcagaaagcttctctctagtttttacctgaagttatttcctttttcactgtaggccacaatgtactccgtaatattcttgcactgattctacaaaatcagtgtttccaaactgctgagaaagggatgttttagctctgtgagatgactgcacacatcacaaaatgatttcttatatagcttccttccagtttttatcatggatattcgctttttcaacttgggcctcaatgagttcccaaatatcccttcgcagattatacaaaaaccttgtttccaatctgctgaatccaaaggaaggttgaactctgtgagatgaatgcacacatcacaatgcagtttctcagaaagcttctttggagtttttatctgaagataattcctttttaaccccaggcctcaatgcactcccaaatatgtctttgcagattttaccaaaacagtgtttccaaactgctaaatgaaaagaaagttttaactctgcaagattaatgcaaacattgcaaagtggtttgtcagatagcttccttgaagtttttatcctgggatatttgctttttcaccattggcctcaatgagctcccaaatatccctttgctgattatacaaaaacagtgtttacaaactgctgtatcgaaggaaagttttaaatctgtgagatgaatgaacacatcacaaagcagtttctcagaaagctgcttttagttttaatctgaagttatttcttttttcaccatgggcctcaatgcacacccaaatatccctttgcatatattacaaaaacattgtttccaaattgctgagtgaaaagaaaggtttatctctgtgagatgaatgcacacatcacaaagcggtttctcagatagcttccttctagtttttatcctggtatattgtctttatcacctttggcctcaatgagcactcaaatatctggttttgtccattctgcgaatggacatttgggagctctatgaggccagtgctgaaaaagtgaacatcccagcataaaaactagaaagtacctttctgagaaactgctttgtgatgtgtgcattcatctctcagagttaaaagtttccgtggttccagcaatttggaaacactgttttcaaagaatcttcaaaaggatattttggagctcattgaggacaaaggtgataaagtgaatatcccattataaaaactagaaggaagctatctgagaaaccactttgtgatatgtgcattcatttcacagagttaaacatttttcttctttcagaagtttggaaacagtgtttttgtaggctctgggatgggatatttgggaagacattgaggcatgtggtgaaaaaggaaatatattcagataaatcctagaaaaaagctttctgagaaacccttcatgatgtaagcattcatctcacagagttaaaactttcttaggattcagcagtttggaaaacctgtttctgtccattctgcaaatggatattttggagctcatttagtccaatgtcaaaaaagcaaataaccctggataaaaaattgaagaaagctatctgagaaactgctttgtgatatgtgcattcttctcaaagagttaatcttttcttttcatccagcagtttggaaacactgcttcagtgtaatctgtgaagggatatttgggagcgcattgaggcctaaggtgaaaaaggaagtatcttcagataaaaactagatagaacttgtctgagaaactgctttgtgatgtgtgcattcatctcacagagttaagcctttctttgggttcagcaatttggaaacagtgtttttgtagaatctgtgaaggggtttttgggagctcattgagtctaaaggtgaatatcccaggataaaaactagaagaaagctatctgagaaaccgctttgtgatatgtgcgttcatctcacagagttaaaattttattttcattcagcaatttggaaacaatattttggtagaatctgcaaaggggtatttgggagcactttgatgcctaagtagaaagggaaatatattcagataaaaactagaaataagctttctgagaaacttcttggtgatgtgtgcaatcaagtcacagagttaaaccttcctttggattcagcagtttggaaccactgtttttgtccattctgtgaatggacatttgggagctcattgtggccaatggtggaaatgtgaataccccaggtaaaaactagaagaaagctgtctgagaaactgctttgtgatgtgtgatttcacctcatagagataaacctttcttttcattcaggagtttagaaccactgtttttgtccattctgcaaatggatatttgggaagcccattgtggcaaatggtgaaaatgcgaatatcccacgtaaagcctagaagaaagctgtctgagaaactgctttgtgatgtgtgcatttatttcacagagttaaatgtttctttgcattcatcagttttgaaatactgtttttgtagaaagagtgaagggttatttgggagttcattgaggctaaaagtgataaagcaaatatcccaggataaacactagaaggaagctatctgtgaaattgctttgtgatgtgtgcattcatctcgcagaggtaaaccatccttttcaggcagcagtttggaaacactctttgtgtagaatctgagatggggtatttgggagtgcattcagtcccatggtgaaaaaggaaacatcttcagataaaacctagaaagaagctttgtgagaaactgctttgtgatgtgtgccttaatctcactgagttaaacctttgttgtcagcagtttggaaacactattttgtagaatgtgcaaagagttatttgggaggtgattgaggccaaagcaaatatcccactaagaaaactagaaggaagctatctgagaaattgctttgtgatgtctgcattcatctcgcagagttaaactcttctttttattcagcactttggaaatactgtttttgagcattctgggaacggaaatttgggagattattcaggccaatggggaaacagggaacatcccaggataaaaactataaggaagctttctgagaaaatggtttgtgaagtggacttcatctcgctgagttaaacctttgttttcattcagcatttggaaacacttcttgtagaatctttgaagggatatttgggaatgcattgaggcctacagtgaaaaagcaaatatcttcagataaaaactagaaacaagctttctgagaaactgatttgtgatgtgtgtattcatctcacagagttaaacctttctttttcattcagcagtttggaaacactgtttttgtagaacctgcaaagtgatatctgggatcacattgaggtttatgttgaaaaaggaagtatcttcagataaaaactagagaaatactttctgagaaactgctttgtgaatactacattcagctcacagagttcaacctttctttggaatcagcagcttggaaacactgttgttgtagaatctacaaagggatatttgggagctcactgaggccaatggcaaaaaattgaatatcccaggaaaaaaaacgagaaggaagctttgtgagaaagcgctttgtgatgagtgcattgacctcacagagttaaaactttgttttcattcagcagtctggaaacaccttttcagaagaatttgtgaagcagtatttaggagcacattgaggcctatggtgaaaaaggaaatatcttcatataaaaactagaaagaagctttctgtgaaactgttttgtgatgtgtgcattcatctcacagagttaaatctttcttttcattcagaagtttggaaacactgtttttgtagaatctgcgaaggagtactttggagcgcattgagatctatgttgaaaaaggaaatatcttaaaaactagaaagaaactttctaaaaaacttctttgtgatgtgtgcattcattttgagataaaacctttctttggttttagcagttggaaacacagttttggcagaatccataaagggatatttgggatctcattgaggccaatggtgaaaaaacaaatatcacaggataaaaactagaaggaagctatctgagaaactgctttgtcatgtgtgcattcatcgcacagagttaaatgtttctgtgtattcagtagtttgcaaacgctgtgtttgtccattctgcaaattgacatttggattctgtgaggcctatggcaaaaaactgaaaatccaaggataaaaactggaagaaagctacgtgagaaactgctttgtgttgtgagcattcacctcacagagataaagctttcttttcgttcagcagtctggaaaaactgttctggcagaatccacgaagggatacttgggagcaccttgaggtctattttgaaaaaggaaataacttcagataaaaactagaaagaatctttcagagaaactgcattttgatgtatgcattcatctcacagagttaaaccatcctgtggattcagcagttttaaaacactgtttttgtccattctgtgaatggacatttgggagctctttgacttcgatggcaaaaaagcaaatatccaagaataaaaatgagaatgatgctatttgagaaactgttttttgatgtatgcattcatctcacagagataaacctctcttttcaatcagcagtttggaaacactgttttcatagaatttgtgaaggggtatctgcgaatgcattcaggtctatgatgaaaaaggaaatatcttcagataaaaactaggaaggtttctgagaaactcctttgtattgtgtgctttcatctcacagagttaaaacttactttggattcagcagtttggaaacacggttgttgtagaatctgtgaagggatatttgggatctcattgaggccaatggtgaaaaagtgaatatccctggataataagtagaaggaagctatttgagaaactgctttgtgatgtgtgcattcatctcacagacttaaacgtttcttttcaataagcagtttggaaactgttttcatagaatttgtgaggggtatctgggagttcattcaggtctatgatgaaaaaggaaatatctacagataaaaactagaaagaaggtttctgagaaactgctttgtgatgtgtgcattcatctcacagagttaaaactttctgtggagtctacagtttcaaacactgtttttgtccattctgtgaatggacatttgggagggcattgaggccaatggtgaaacagcgaatatcccaggataaaaacaagaaggaagctatctgagaaactgctttgtgatgtgtgcattcagcttgcagagatagaacatcgttttcgttcaacagcctggaaacactgttttggcagaattctcaaagggatatttgggagtgcattgaggcctatggagaaaaaggaaatatcttcagatataactagacagaaacagtgctgggtatggtgactcatgcttgttatcccagcactttcataggcagcggtgggcagatcacaaggtgaggatttcaagaccatcctggctaacacagtgaaacccagtctatacaaaaaaatagaaaaaattagccaggcgtggtggtgggtgcctgtagtcccaactactcaggaggctgaggagaagaatggcaagaaccccagagatggtgcttgcagtgagccgagatcatgccaatgttctccagcctaggggacagagcgagactctgtctcaaaaaaaaaaaaaaaaaaaactagacagaagcattctgagaaactgctttgttgtgtgaattcatctcacacagttaaacatttctttcatttagaagtttggaaagactgtttttgtagaatctgtgaaatggtatttgggaatgtattgaggcctatggtgaaaaaggaaatatcttcagatgaaaactagaaagaagatttctgagaaactgctttgtgatgtgtacattcatctcacagagttaagtctttctgcgtattcaatagtttgcaaacagtgtttttgtccaatctgtgaatggacgtttggagctctttgaggccaatggcaaaaaagtgaaaatcctaggataaaaactgcaagaaagctatgtgaggaacagctttggtgtgtgtgcattcacctcacagagttaaaactttctattcattcagaagtctggaaacactcttttggcagaatccaagaagacatatttgggagtgcactgaggcctatggtgaaaaagaaaatatctcaagataaaaactagaaagaacctttctgagaaactgcgaagggatatttgggatctcattgaggccaatggtgaaaaagcaaatatcacaggataaaaactagaaggacgctatctgaaaaagtgctttgtgatgtgtgcattcatctcacagagttaaatctttcttttcattctgcagtttggaaacattgttttggtagaatctgcgaaggtatataccttcggagcgcattgaggcctatggggaaaaaggaaatatctacagataaaaactagaaagaagctttctgagaaactgttttgtgatgtgtgcattcatgtcacacagttaagcttttctttatatccagcagattggtaacactgttatatccattctgcgaatggacatttgggagctcattgaggctaatggttaaaaaacaaataacccaggataaaaaatataaagaacctatctgagaaaatgctttgtgatgtgtgcattcacctcacagagttaaaactttcttttcattcagcattctggaaacactgttttggcagaatctgtgaaggcatatttgggagaccattgaggcctatggtcaaaaaggaaatatctcaagataaaaactagaaagaagttgtgtgagaaactgctttgtgatgtgtgcatatgtatcacagagttaaaacattccgtgaattcagcattttgagaacactgtttttatccattctgcaaatggacatttgggacctcattgaggccattggtggaaaagtgactatccgaggataaaaactggaaggaagctatctgagaaaatgcttcatgacgtgtgcattcaactcacagagataaagctttcttttcattaagaagtctggaaacactgctttaggagaatctgcaaagggatatttgggagcactgtgaggcctatggtgaaaaggaaatatcttcagatgaaaagaagaaagaagttttctgagaaactgctttgtgatgtgtgcattcatctcacagaagtaaacctttctgtgggttcagcagattgcaaccactgtaaatgtccattctgtgaatggacatttggaagttcattgaggccaatgtcgaaaaagcgaatatcccaggataaaaactagaaggaagctatctgaggaactgctttgtgatgtgtgcattcatctcgtagagctaacctttcttttcattcagcagtctcaaaacacagctttggcagaatccacgagggcatatttgggagcacattgaggccaatggtgaaaaagtaaatatcttcagataaaaaataaaaaggtttctgcaaaactgctttgtgatgtttgcattcattttacagagttaaatatttctgtggattcagcactttgcaaacactctttatgtccattctaggaatggacatttgagaactcattgattccaatggcaataaagcaaatatcccaggagaaaaactggaaagaagctatctgataaacttccttgtgatgagtgcattcatcccacagagttaaacgtttcttttcattcattcatttgaagcactgtttttgtagaatctgtgaagggatatttggcagtggagtgaggcctatgtaggaaaaggaaatatcttcagatataatctagagaaaagctttctgagaaactgttttgtgatgtgctcatgtcacagagttaaacttttctttggattcagcagtttggaaacactgtttttgtccattctgcaaatggatatttgggagctctttgaagccaatggtgaaaaagagaatatgccaggataaaaaccagaaggaagttatctgagaaaacgattggtgatgtgtgcattcatctcacagagttaaaactttcttttcattcagcagtttggaaaaccttttttgttagaatctgcaaagagatattttgtaagtcattgagacctatggtaaaaaggatatatcttcaaagaaaaacaagaaagaagcttaatgacaaacaggtttgcgctgtgtgcattcatctcagagagttactcctttctttggattcagccttttggtaacactgtttttgtccgttttgcaaatgcacatttgggagctcattgaagccaatggagaaaaagtgaatatccgaggaaaaaaactagaaggaagctataggagaaactgattcatgatgtgtgcattcatctcacagagataaacctttcttttccatcagcagtttagaaacactgttttcttagaatctgtgaagaggtattaggaagagtatggaggccaatggttaaaaaggaaatatattcgtataaaaactagaaagaaacttaatgagaaactggtttgagatgtgtgcattcatctcagagagttaaacgtttctttggattcagcagttttgaaacactgtttttgtccatactgtgaatggatatttcagagctcattcaggccaatggcagaaaagaaaatatcccatgattaaaaatagaagaagctatctgagaaaccgtcttgtgatgtgtgcattcatctatcagagttaaaactttcttttcattcagcagcttggaaacattgtttttgtagaaactgctaaagggtatttggcagcacattgaggtccatggtgaaaaagaaaatatctgcagataaaaactagaaagaaaatttctgagaaattgctttgtgttgtgttcattcatctcacagagttaaacttttctatggattcagcagtttggaaatgctgtttttgtccattctgcaaatggacatttgggagctcattgaggccaattgtgaaaaaatgaatatcctaggagaaaaacttgaaggaagttatctgagaaaccagttcatgatgtgtgcattcatcttatagagttaaatctttcttttcattcagcagtttagaaacactgttttcttagattctgtgaaaagatatttggaagggtatgggggccaatggtaaaaaaagaaatgacttcagataaaaatatgaaagaggcttaatgagaaagttgtttgcaatgtatgcattcatctcagattgttaaacgtttctttggattcagcagtttagaaacactgtttttatccattctgtgaatggacgtctgggagctcattgaggccaatgtcaaatgagcgaattcccaggattaaaactagaaggaaagtatctgaaaaacagctttttgatgtgtgcattcatctcacagagataagcctttcttttcattaagcagtttggaaacactgtttttgtagaaactgtaaaagatatttggcagcacattgaggtctacagtgaaaaggggaatatattcagataaaaactggaaagaagccttctgagaaactgctttgtgatgtgttcattcattgcacacagttaaagatttctttggattcagcagtttggaaatactgtatttgtccattgtgtgaatggattttgagagctcattgtggccaattgtgaaaaattgaatatcacaggataaaaactagaagaaagttatatgataaaccaattatatatgtgtgcattcatcttacagagtaaaactttgttttcattctgcagtttggaaacactgatttcttagaatatgcgatgagatatttggtaccgtattgaggccaatgttgaaaaatgatataacctcagatataaactagaaagaagctttctgagaaactgctttgtgatgtgttcatttatgccacagagttaaacttttctttggattcaccagtttggaaacactgtttttgtccattctgcaaatggacatttgggagttcattgacgccaacgggaaaaaagtgaatatcccaggataaaaactagaaggaagctatatgagaaaatgattcatgatgtgtgcattcatctcaaagagttaaaactttcttttcaatcagcagtttggaaacactgattttttaaaatctgtgaaaagatatttggtaacacattaaggcctatggtgaaaaaggaaatatcttcagataaaaaccagaaagaagttttcttagaaactggttttgcttgtgtgcatttatctcagagagttaaaactttctttggattcagcagtttagaaacactgtttttgtccattctgtgaatggacgtttgggagctcattgaagccaacgtcaaaaaggtgactaacccaggattaaaacttgaagaaagctatctgagaaatagctttctgatgtgtgcattcatctcacagagttaaaactttcttttcattcagcagcttggagacactctttttggagaaactgctaaagggtatttggcagcacgttgaggtccatggtgaaaaaggaaatatctgcagataaaaactagaaagaaaatttctgagaaattgctttgtgttgtgttcattcattcacagagttaaacttttctatggattcagcagtttggaaatactgtttttgtccattctgcaaatggacatttgggagatcattgaggccaattgcaaaaaagtgaatatcccaggagaaaaacttgaaggaagttatctgagaaacaaattcatgatgtgtgcactcatctcacagagttaaatctttcttttaattcagcagtttagaaacactgttttcttagaatctgtgaaaataaatttggaagggtatggacgccaatggtgaaaaaagaaacggcttcagataaaaatatgaaagaggcttaatgagaaagttgtttgggatgtgtgcattcatctcagattgttaaacgtttctttggattcagcagtttagaaacactgtttttatccattctgtgaatggacgtctgggagctcattgaggccaatgttgaaaaagcaaatatcccaggattaaaactagaaggaagctctctgtgaaacaggtttgtgatgtgtgcattcatctcacagagttaaacctttcttttcattcagcagtttggaaacactgtttttgtagaaactgcaaaaggatatttggcagcacattgatgccaatggtcaaaagggaaatatgatagaaactagaaagaagctttctgagaaactgctttgtggcgtgttcattcatctcacagagttaaatctttctttggattcaacagtttggaaacactgtttctatccattcttggaatggacatttgggagcttattgaggccaaaggcaaaaaagcgaatatcccaggataaaaactagaaggaagttatctgagaaaccgattcatgatatgtgcattcatttcacagagttcaacttttcttttcattcaccagtttggaaacattgttttcttagaattttcaaagtgatatttcaaagaatatgcaggccactggtgaaaaaggaaatgtcttcagataaaaactagaaagaagcttaatgagaagctggattgggatgtgtgcattaatctcagagagttaaaccatcctttggagtcagcaggttttaaacagtgtttttatccattctgcgaatgttcattttggagctcattgagggcaatggagaaaaagtgaatatcccaggataaaaagtagaaggaagttatgtgataaactgattcatgattcatgcattcatcatcagatttaaacccttcttctcaattagcagtatggaaacaggtgattttttaaaaactgggaagagatatttggtagcacattgaggcctatgggggaaaaggaaatatcttcacataaaaagtagaaagaatctttctgacaaactgctttatgatgtgttcattcacgtcacagagttaaacctttttttggattcagcagtttggaaacactgtttttgcctattctgcaaatgaacatttgggagcttattgaggccaatggcaagaaagcaaatatcccaggataaaaactagaaggaagttatctgagaaactgatttgtgatgtgtgcattcttctcaaagagttcaattttcttttcattcagcagtttggaaacactgctttgtagaaactgggaaagaatatttggcagtgcatggaggcctaatgtaaaaaaggaaataccttcagataaaaactagaaataaactttctgagaaactgctttgtgatgtgttcattcacctcatagagttaaatatttctttggattcagcattttggaaacactacttttgtccatttcgtgaatggacattttggaacacattgaggccaatggcacaaaagcaaatgtcccaggagaaaaacttgaaggagtttatctgagaaactgactcatgttgtgtgcagtcgtcccatagacttacaactttcttttcgttcagccgtttagaaacactgttttcttagaatctgccaagagatgtttggaagacaatggaggtcaacaatgaaaaaggaaatatcttctgttaaaaattagaaagaagtttaatgagaaactcgtttagcatgtgtgcattcatctcagagagttaaaccagtctttggtttcagcagtttgaaaacacagtttttgtgcattcttggaatggacgtttgggaactcattgaggccaatggtgaaaaagtgaatatcacaggataaaaactagaaggaagttatctgagaaatcaattcatgatggcagtattcatctcacagagttaaacctttctgttcattcaaccatttgcaaacactgatttcttagaatctgtgaagagatatttggtagtgcgttgagtcctatggtgaaaaagtatatatattcagataaaaactcgaaagaagctttctaagagactgatttgtgatgtgttcattcatcccacagagttaaatctttctttggattcagcagtttggaaaccctgtttctgtcaattctgggaatggacatttgggagctcattgagaccgatggggaaaaagtgaatatcccaggataaatactagaaggaagttatatgagaaactgattcgtgatgtgtgccttcatctcagagagttaaacattcctttagattcagaagtttggaaacactgtttgtgtccattctgtgaatggatgcttgggagcttcttgaggccaatgtcaaaaaagggaatatcccagtattaaaactagaatgaagctatcttaggaatggctttgtggggtgtgcattcatctcacagagttaaacatttgttttcattcagcagttttgaaacactgatttcttagtatatgcaaagagatatttggcagtgcattgaggcccatggtgaaaaaagaattatcttcacataaaaactagaaacaagctttctgagaaaccactttgtaatgagttcattcatctcacagagttaaactttttctttgattcagcagtttagaaatcctttttttgtccatgattcatgatgtgtgcattcatcacagagagagaaaactttctttggattccacagtttggaaacactgtttgtgtccattctctgaatggacgttagggggctcattgaggccaatggtgaaaaagcaaatatcccagtattaaaactagaaggaagcgatctgagaaaaggctttgtgatgtgtgcattcatctcacagagttaaacatttctcttcattcagcactttggaaacactgatttcttagaagctgcgaagagatatttggtagtgtattgaggtccatggtgaaaaaggaaacgtcttcagataaaaactagctaaaagctttctgataaacttctttgtgatgtgttcattcatctcacagagttaaactttttctttgattcagcagtttagaaatcctgtttttgtccattcagcgaatggatattttgtagctcactgaggcaaaaggtgaaacagtgaatctccctggataaaaatgtgaaggaagcaacctcaggaaacaattattgatgtctgcatccatctcatagataaatctttcttttcattcagctgtttaaaaacactgttgtcttagaatctgccaagagatatttggtattgcatagatgcccatggtgaaaaaggaaatatcttcagataaaactagaaacaaacttaatgagaaactagttcgggacgtgtgcactcatctcagagagctaaatctgtctttgtattcagcagtttggaaacacagttttggtccattcttggaatatacattggggaactcattgaggtcaatggcaaaaaagtgaatatcccgtgatcaaaactagaaggaagttatttgagaaaccaactcgtgatggttgcattcatttcagagttaaacctttctttgcattcagcagtgtggaaatactgtttctgttgatcctgcgaatgaacatctgggagctcattgatgccaatggcaaaaatgcgaatatcccaggataaaaacttgaagaaagttatctgagaaacttcttgttgatgtttgctttcatctagcagagttaaatctttcttttcattcagaagttaggaaacagtgttttctaagaatctgcaatgatatatttggtagcatattgtggcccatggcgaaaaaggaaatatcttcagtccaaaagtagcaagaagctttatgagaaactgccttgtgatttgttcgttcatccaatagagttaaacctttctttggattcagcagtctggtaacactgtttttgtccgttgtgcgaatggacgttgggagctctttgaagccaatggcaaaaaaagagaatatcccaggattaaaactagaaggaagctatctgagaaaccacctagtgacgtgtgcattcatctagcagagttaaacctttcttttctttcagcagtttggaaacactgtctttgaagaaactgtgaaatgatatttggcagcgcattgaggccttagctgaaaagggaaatatcttcagataaaaagaagaaagaaactttctgagaaactgctttgtgatgtgttctttcatctcacagagttaaacatttatttgcattcagcagttttgaaatgccgtttgtgtccattttgtgaatggacattttggagaacactgtggccaatttcaaaaaagcgaatatcccaggataaaaacttgaaggaatttatctgagaaagtgtctcatgatgtgtgcattcagctcacagagttaaaccttccttttcattcagcagtttagaaatgctgttttcttagaatctgccaagagatatttggaagactgtggaagtcaatggtgaaaaaggaaataccttccaataaaaactagaaagaagcttaatgagacactcgtttggcatgtgagcattcatctcagagagttcaacctgtctttggtttcagcagtttggaaacacagtttttgtacattcttggaatggacgtttgggaactcattgaggacaatggtgaagaaatgaacgttttttctagttcttttaattgtgatgttagggtgtaaattttggatctttcctgctttctcttgtgggcatttagtgctataaatttccctctacacactgctttgaatgcttcccagagattccggtatgttgtgtctttgttctcgttggtttcaaagaacatcattatttctgccttcatttcgttatgtacccagtagtcattcaggagcaggttgttcagtttccatgtagttgagaggttttgagtgagattcttaatcctaagttctagtttgattgcactgtggtctgaacaattaaaaaaacgagaaaagcaagagcaaacacattcaaaactagcagaaggcaagaaataactaaaatcagagcagaactgaaggaaatagagacacaaaaaacccttcaaaaaattaatgaatccaggagctggttttttgaaaagatcaatgaaatagatagaccgctagaaagactaataaagaaaaaaagagagaagaatcaaatagatgcaataaaaaatgataaaggggatatcaccaatgatcccacagaaatacaaactaccatcagagaatactacaaacacctctatacaataaactagaaaatctagaagaaatggataaatttgtcgacacatattctcccaagactaaaccaggaagaagttgaatctctgaatagaccaataacaggagatgaaattgtggcaataatcaatagcttaccaaccaaaaagagtccaggaccagatggattcacagccgaattctaccagaggtacaaggaggaactggtaccattccttctgaaattattccaatcaatagaaaaagagggaagcctccctaactcattttatgaggccagcatcattctgataccaaagccgggcagagacacaaccaaaaaagagaattttagaccagtatccttgatgaacattgatgcaaaaatcctcaataaaatactggcaaaacgaattcagcagcacatcaaaaagcttattcaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggcattgatgggatgtatttcaaaataataagagttatctatgacaaacccacagccaatatcatactgaatgggcaaaaactggaagcattccctttgaaaactggcacaagacagggatgccctctctcaccactcctattcaacatagtgttggaagttctggccagggcaattaggcagaagaaggaaataaagggtattcaattaggaaaagaggaagtcaaattgtccctgtttgcagacgacatgattgtatatctagaaaagcccattgtctcaggccaaaatctccttaagctgataagcaacttcagcaaagtctcaggatacaaaatctacgtacaaaactcacaagcatccttatacaccaacaacagacaaacagaaagccaaatcatgagtgaactcccattcacaattgcttcaaggagaataaaatacctaggaatccaacttgcaagggatgtgaaggacatcttcaaggagaactacaaaccactgctcagtgaaataaaagaggatacaaacaaatggaagaacattccatgctcatgggtaggaagaatcaatatcgtgaaaatggccatactgcccaaggtaatttgcagattcaatgccatccccatcaagctaccaatgcctttcttcacagaattggaaaaaactacttaaagttcatatggaaccaaaaaagagcccgcatcaccaactcaatcctaagcaaaaagaacaaagctggaggcatcacactacctgacttcaaactatactacaaggctacagtaacgaatacagcatggtactggtacaaaaacagagatatagatcaatggaaaagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcaataccgttcaggacataggcatgggtaaggacttcatgtctcaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgagctcaaacaaatttacaagaaaaaaaaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagttaccatctcacaccagttagcatggcaatcattaaaaagtcaggaaacaacaggtgctggagaggatgtggagaaataggaacacttttacactgttgttgggactgtaaactagttcaaccattgtggaagtcagtgtggcgattcctcagggatctagaactagaaatgccatttgacccagccatcccattactgggtatatacccaaagggttataaatcatgctgctataaagacacatgcacatgtatgtttattgcagcactattcacaatagcaaagacttggaaccaacccaaatgtccaacaatgatagactggattaagaaaatgtggcccatatacaccatggaatactatgcagccataaaaaatgatgagttcatgtcctttgtagggacatggatgaaattggaaatcatcattctcagtaaactatcacaaggacaaaaaaccaaacaccgcatattctcactcataggtgggaattgaacaatgagatcacatggacacaggaaggggaacatcacactctggggactgttgtgggattgggggaggggggaggggtagcaatgggagatatacctaatgctagatgacaagttagtgggtgcagcgcaccaatgtggcacatgtatacatatgtaactaacctgtacaatgtgcacatgtaccctaaacttaaagtataataataaaagaaaaaaaaaagaaaaaaatgaatatcacaggatgaaaacttaaaggaagttacttgagaaaccaattcgtgatgtatggattcatctcacagagttaaaccttccttttcattcagcagtttggaaacactgattcttagaacctgcaaagggatattttttagcacattgaggactttggtgaaaaaggatatatcttcagaaaaaaaactcgaaagaagctttctgagaaactgctttgtgataagttcattcatcccacaaagttaaaactttctttggattcagcattttggaaaccctgtttctgtcgattctgtgaatcgtcatttgggagctcattgtggccgatggggaaaaagtgaaaatcacattataaacactagaaggaagttacctgagaaacaaattcgtgatgtgtgcattcatctcagagagttaaaattctttggattcaacagtttggaaaccctgcttgtgccaattctgtgaatggacgtttgggagctgtttgaggccaatggtcaaaaagtgaatatcccagtattaaaactagaaggaagatatctgagaaatggccttgtgatgtgtgcattcatctcccagagttaaagatttctcttcattcagcagtttggaaacactgaattcttagaatctgtgaagagatatttggaagcacattgaggccaatggtgaaaaaggaaatatcttcaaataaaaactagcaagaaattttctcagaaactgctttgtgatgtgttcattcatctcacagagttaaacttttatttggattcagcagtttggaaatactgcttttgtccatctgctaatggatatttgggagctcactgaatctaatggcaaaatgatgaaactcccaggataaaaacttgaaggaactgatctcagaaaccgattagtgatgtgggcactcatctcacagaggtaggtctttcttttcattcatctctttagaaacactgttgtctttgaatctgccaagagatattttgtagtgaatggaggcccatgttgaaaaaggaaataccttcagataaaaactagcaagaagctttgtgagaaacccctttgtgatgtgttcattcatcttacagagttaaacttttccttggtttcagcagtttggaaatactgcttttgtccattctagtaatggatattttggagctcactaaatccaatggtgaaatagcaaatctcccaggataaaaaatttgaaggaattgatctcaggaaccatttagtgatgtgtgcattcatctcacagagttgtctttcttttcattcagctgtttagaaacactgttgtcttagtatctgccaagagatatttggtagctcatggaggcccatggtgaaaaaggaaatatcttcagataaaaactagaaacaagctaaaagagaaacttgttccagatgtgtgcattcatctcagagagttatatctgtctttgtattcagcagtttggaaacagagttttggtccattcttggaatattcattggggaaatcatggaggccaatggtgaaaaagcgagtatcccaggaccaaaactacaaggagattatttgagaaaccagttcgtgatgggtgcattcatctcacagaattaaacctttctttgcattcagcggtgtggagacactctgtctgttgatcctgtgataggatatttgggaactcattgaagccaatggcaaaaaagtgaatatcccaggagaaaaactagaaggaagttacatgagaaacttcttagtgatgtgtgcattcatctagcagaggtaaacctttcttttctttcagcagtttggaaaaactgtgtttgtagaaactgcaataggatatttggcagtgccttgaggcctaaggtgaaaaaggaaatatcttcacataaaaactaggaagaaactttctgagaaactgctttctgaagtgtttttcatctcacagagataaacatttctttggattcagcagtttggaaatgctgtttgtgttcattttgccaatggacattttggagcacattgaggccaaaagtgaaaaagagaatatcccaggataaaaacttgaaagaatttatctgagaaagtgagtcacgttgtgtgcattcagctcacagagttaaacccttcttttcattcagcagtttagaaacactgttttcttagaatctgccaagagacatctggaagactatggagatcaatggtgaaaaaggaaatatcttccgataaatacttgaggggcttaatgataaactcgtttcacacgtgtgcattcatctcagagagttcaacctgtcttttgtttcagcagtttggaaacacagtttttgtacattcttggaagggacatttgagacctcattgaggccaatggagaaaaagcgaatattgtaggatgaaaactagaaggaagttatctgagacaccaattcataatgtgtgcattcatctcacagagttaaacctttcttttcattcagcagtttggtaacactgttttcatataatctgcaaagagacattttttagcgcattgaggcctatggtgaaaaaggatatagcttcagataaaaacttgaaagaagctttctgagaaactgctttgtgatatgttcattcatctgacaaagttaaacctttctttagattcagcagtttggaaaccctgtttctgtcgattctgtgaatggacatttgggacctcattgaggctgatggggtaaaagcgaatatcccaggataaaaactagaaggaagttacataagaaaccaattcatgatgtgtgcattcatctcagacagttaaacctttctttggattcagaagtttggaaaccctgtttgtgtccattctgtgaatgcacgtttgggagctcactgaaaccaatggtggaaaagcaaatatcccagttttaaaactagaaggaagctatctgagaaacggctttgtgatgtgtgcattcatctcacagagttaaacttttcttttcattcagcagtttggaaacacagatcacttaggatctacgaagagatatttggtagttcattgaggcccctggtgaaaaaggaaatatcttcagataaaaactaccaagaagctttatgagaaactaataaggtgatgtgttcattcatctgacaaagttaaggccaatggaaaaaaggaaatattgcaggaaaaaacttgatgaaaattatctaagaaaccaattcacgatgtgtgcattcatctcacagagataaacttatcttttcattcagcagtttggcaatgctgtttctctcgatcctgtgaatggacatttgggagctcattgtagccaatgaaataaaagtgaatatccaaggataaaactagaagcaagttatctgagaaagttcttagtgatgtgtgcattcatctagcagagttaagcccttcttttcattcagcagtttggaaagagtttcttcttaggatctgcgaagaggttctcaagcattcccaaatatccatttgcagattctataaaagatggtatccaaactgctcaatcaaaagaatggctcaactctgtgagaggaatgcacacatcactaagaactttctcagaaagcttctgtctagtttttatgtgaacatatttcgttttcaccatatgcctaaaagtgcatgaaaatatccttttgcacattctacacaaaggttgtttccaaacagctcaaacaaaagaatgcttcaactctgtgtaatgagtgcacaccacgcaaagaagcttctcagaaaccttctgtctagtttttacgtgaagatatttcctttttcatcgtaggactcataatgatcccaaatatccctttgctgattctacgaaaagatggttgtcaaactgctcaatcaaaacaatgtttctactctgtgatatgtatgcacacatcacaaatatgtttctcagaaagcttctgtctagatgttgtatgaacatatttcttttttcaccataggcctcaaaaggctctgtaatatcccttagccagttctaaaaaggagtggttccagacttctcaatgaaaagaatggctcaactctgtgaaatgaatgcacatatcacaaagcagtttctcagaaagcttctctctagtttttgtgaagatatttgctttttgaccatagacctcaaagcagtcacaaatgtccctccacatattctacaaaaagactctttccaaactgctcaatcaaaagaatggttcaactctgtgagatgaatgcacacgtccaaagcagtttctcacaaagcttccttctagtttttatgtgaagatatttcctttttctccactggcctttaaccattccccaaattccttttgctgattctatgaaaagactatttccaaactgctcaatcaaaagaatggttcaactccgtgagatgaatgcacacatcaaaaagaagtttctcagaaatcttctgtctacttttttgtgtgaagatatttcctttttcaccataggcctcaaagtgctcaaaatatccctttgcagatctcacaaaaagactgtttccaaaatgctcaatcaaaagaatttttcacctctatgagacgaatgcacacatcatatagaggtttctcagaaagcttttgtctagtttttatgtaaagatatttacttcttcaccattggcctcaaagggctcacaaatatccctttgcagattctagaagaacagagtttccaaactgctcaatgataagaaacatttacctctgtgagatgaatgcaaagctaaacagaagctttctgagaaacttctttgtgatgtgtgcattcacgtcacagagttgaacaatcacattgattgagcagtttggaaaccatcttttggtagaatctgcaaagggatatttgtgagcactttgagtcctatactgataaaggaaatatcatcacataaaaactaggaaaaatgtttctgagatactgctttgtgagtttgtattcatctcacagagatatacgtttcttttcattgagcagtttggaaaatctgttcttgtagaatctgcaaagggatatttctgagcgctttaaggcctatggtgaaaaaggaaatatcttcacataaaaaccagacagaagcttcctgagagactgctttgtgatgtgtgcattcatctcaaagagttaaatgtttcttttcattaagcactttggaaactctgttcttccagtatgtgcagacagatatttgtgagcacttcgatgcctatggtgaaaaaggaaatatcgtcacataaaaattacacagaagctttctgagaaagttctttgtgatgtctgcattcatctcacagtgttgaaacattctttcgattgatcactttggaaggagtctttttgtagaatctgcaaagggatatttttgagtcatttgaggcctatgctgaaaaaggaaatatctccacataaaaactatccagaaggtttctgagaaactctgtaatgtgtgccttcatgtcagagtggaaggattatttagattgagcagtgtggaaacattctttttgtagaatcttcaaagggatatttgtgagcgctttgaggcctatggtgaaaaagaaatatcttcacataaaaactagacagaatgtttctgaaaaactgctttctagtgtgtgctttaatttcacagatttgaaccatacaatgcttttgattgagcagtttggaaacagtctttttgtagaatctgcaaaaggatatatttgaggtgcactttgagacctatggtgaaaatggaaatatcttcacataaaaaccagacagaagctttctgaaaaactgccttgtgatgtgtccattcacctcacagaaataaacgtttcttttcattcagcattttggagactctgtccttctataatctatgaaaggatatttcagaagacttggaggcctatggtgaaaaaggaaatatcttcacataaaaagcagacagaaactttctgagaaaattctttgtgatgtgtgcattcatgtcaaagagttgaaacattcttttgattgagcagcttggaaacagtctttctgtagactctgcaaagggatattcataagtgctttgaggcctttggtgaaaaaggaaatatcttcacatacaaactagacagaagctttttgagaaacttctttgtgatgtgtgcattcatctcacagagttggacaatgtttttgattgagcactatggaaactgttcttgtagaatcttcaaagggatatttgtgagtgatttgaggctgatggtggaaaaggaaatatcttcacataaaaactagaaagaagcttactgagaaactgctttgtgttgtgtacattcatgtcagagaagtagacgtttcctttcattgagcagtttggaaacactgtaattctagaatctgcaaagggacatttgtgagctctttgagggctgtgatgaaaaaggaataatcttctcataaaaaccagacaaaaatttctgagaaacttctttgtgatgtgtgcattcatcccacaggtttgaaccacacttttgattgagcagtttggaaacattctttttgtggtacctgaaaagggatatttgtgagccccttgaggcctatggtaataaaggaaatatcttcacataaaactagcaaggagctttctgagaagctgctttgtgatgtgtgcattcacctcacagaggtaaatgtttctttgcattgagcagattggaaacactgttcttgtagaatctgcaaagcgatatttgtgagtgttttgaggcctatgttgaaaaaggatatatctgaacaaaaactagatggcagctttctgagaatcttcttcgtgatgtatgcactcatctcacagagttgatccagtcctttgattgagcagtttggaatcagtctttttgtagaatctgcaaagggatatttgtgagccctttgaggcctacattaaaaatggaaatatcttcacataaaaaagtagacataaggtttctgaaaaactgctttgtgatatgtgcattcatctcacagaggtaaatgtttctattcatggagcagattggaaaatctgttcttgtagaatctgcaaagggatatttgtgagtgctttgagacctctggtgaaaaaggaaatatcttcacatgaaaactagatagaagttttctcagaaatttctttgtgatgtgtgtattcatctcacggatctgaacgtttcttttgattgggctgtttggaaaaagtctttttgtagaacctgcaaggggatatttgtgagcaattttaggcctagggtgaaaaaggaaatatcgtcacataaaaactagacagaagctttctgagaaacttcttcgtgaaatgtgcatgcatttcacagagttgaacctcacttttgattgagcagctcagaaacagtctttttgtagaatctgcaaatggatatttgtgactggtttgaggcctatagtgaaaaaggaagtatcttcacataaaaactagacagaagctttctgagaatcttctttgtgaactgtgcattcatctcacagagttgaacctttcttttgattgagctctttggaaactttttttttagaatctggaaagggatattgctgagccctttgagggctatggtgaaaaaggaaataccttcacataaaaactagaaagaaggtttctgagaaactgctttatgatgtatatattcatctcacagaggtaaacctttcttttcattgagcagattggaaactctgttcttgcagaatcctcaaagggataattgtgagcggtttgaggcctatggtgaaaaaggaaatatcttcacataaaaactagatagattctttctgagaaacttctttgtgatgcacgcactcatttcacagagtttaaagtttcttttgattgagcagtttaaaaagagtctttttgtagaatctgcaaagggatatttgtgagcagtttgtgtcctatggtgaaaaaggaaatatcttcacataaaaactagatagactgtttctgagaaacttcttttgaagtgtgcattcaactcacagagttgaaactcacttttgattgagtaatttgtaagcagtctttttgtacaatctgcaaatggatatttgtgagcagtttgaggcctatggtgaaaaaagaaatatcttcataaaaaaacgaggcagaagctttctgagaaacttctttgtgatgtgtgtattcattgcacagagttgaacctttcttttgattaagaagttttgaaacagtctttttgtagattctccaaggggatatttgtcagtgacttgtggcctatggtgaaaaaggaaatatcttcatattaaaactagacagaagcattctgagaaacttctttgagatgtttgcattcatctcacagaggtaaatgtctgttttcatcgagcaatttggaaactctcttcttgtagatctgaaaagggatatttgtgagtgttttgagacctatggtgaaaaaggaaatatcttcacataaaactaggtagaagctttctgagaaatttctttgtgacatgtgcattcatttcaagagttgaaacatttttttgattgagcagtttggaaaacatcttttttaagatctataaagggatatttgtgagcactttgatgcttatggttaaaaagctgatatcttcacataataactagattgcagtttgtgagtaacttctttgtgatgtttgtattattatcacacagttgaactattctaattattgagaagcttggaaactgcctttttgcagtgtctgcaaatgcatattgttgagtgctttgaggcctatgttgaaaaaggaaacatcttcacatgaaaaaaagaaataagctttctgagaaactgcttagttatgtgtgcattcatctcacagaggtaaacttttctattcactgagcacgttggaaactctgtttctctagaatctgcaaagagatacttgtgagtgcattgaggcctagtgtcaaaaaggaaatatcttcacataaaaataagacagaagcattctgagaacttctttatgatgtgtgcattcatttcacagagatgaaccattcttttcattgattagtatggaaacagtgtttttgtaggatctgcaaagggatatttgtgagtgctttcaggcctatggtgaaaaggtaaatatcatcacaaaaaaatagaaagaaggttcctgaaaaactagaaagaggttttctgagaaactgctttatgatgtgtgcattcatctcacagaggtaaacgtttcttttcattgagaagtttggaaactcggttcctctagaatctgcaaagggatatttgtgagcactttgagtcccatggtgaaaaaggaaatatcttcacataaaaagtagaaagaagctttctgagaaactgctttgtgatgtgtcaattcatctcactgaagtaaattttcctgtcattgagcagtttggaaattctgtccttctagaatctgcaaacggatatttgtgagagctttgaggcctgtagtgaaaaaggaaatatctactcataaaaactagacagaaccattcagagaaacatcttcaggatgtgtgcattcatctcatctcacagggatgaaacattcctttgattgagcagtttggaatcagtctttttgaagaatatgaaaaggaatattactgagcgctttgaggtctatggtgaaaaaggaaatatcttcacataaaaactggaaagaagatttaatacagactgctttctgatgtgtgcattagtgtcacagtcttgaaacattcttttcattgagcagttttgaaactcttttcttgtaggatctgcaaagggatatttgtgagtgctttgaagcatatggtgaaaagggaaacatcttcacatagaaactggacagaagctttctgagaaactgctttgtgatgtgtccattcatttcacagaagtaaacgtttcctttcattgagcagtttggaaaatctgttcttgtagaatctgcaaagggatatttgggagctctttgaggcctatggtgaaaatggaaatatcttcacataaataccatatataagatttctgagaaacttctttgtgatgtgtgcattcatctcacagagttgaaccattcttttgatggagcagtttggaaacagtctttttgtagaatctgcaaaggtatatttttgagagctttgaggtctatgttgaaaagaaatatcttcttaaaaaaactagatagaaactctctgagaaacatcttctgttatgtgtgcattcatttcacaagattgaaccattctcttgaatgagcactttggaaatacactttttgtggtatctatgaagggatatttggcagcactttgaggcctatggtgaaaaaggaaatatcttcacataaaaaatagaaaaaggctttatgagaaactgctttgtgatgtgtgcattcatttcacagagttgaaccattttttcatttagcagtttggaaactctgttcttctaaaatctgcaaaggcatatttttgagctctgtgagacctatggtgaaaaaggaaatatcttcaaataaaaaccagaaagaagctttctgagaaactgctttgttatgtgtgcattcacctcacagagttgaaacattattttcattgaggaatttgaaaactgtgtttttgtaagatttgcaaaggtatatttgtgagtgctttgaggcctatagtgaaaaattaaatatgttcccataaaaactagacagaagctttctgagaaacttctttgtgatgtgtgcattcatctccaagaattgaaccattcttttgattcagcattttggggacagtctttttgtagaatctgcaaagggatacatgggagctctttgagtcctatggtgaaaaaggaaataacttcacataaaaactagaaagaagctttctgagaaactgctttgtggtatggccattcatctcacagaaaaaaaggtttcctttcatatagcagtttgtaaagtctgtccttctagaatctgcaaagggatatttgtgagctctttgaggcctatggtgaaaaaggaaatatcttcatgtaaaaactagaaagaaggtttctgagaaactgctttgttatgtctgtgttcatcttacagaggtaaaagtttcttttctttgagcagtttggaaactctcctataatatgcaaagtgatatttgtaagtgatatgagtcctatggtgaaaaagggaatatcatcacaaaaaaattataaagaagctttctgagaagctactttgagatgtgtgcattcatctcaaacagttgaaccattcgtttcattgagcagtttggaaatatctttttgtggaatccaaaaaggtctatttatgagtgctttgaggcctatgatgaaaaaggtaatatcttcacataaaaactagacagaaggtttctgggaaacttctttgtgatgtgtgcattcatctcacagaggtaaacgtttcctttcattgaacagtttgcaaactctgtttttgcagaatctgcaaagggatatttgtgagtgctttcaggcctacagtgaaaagggaaatgacttcacataaaaaatagaaagaaggtttctgagaaactgctttgtgatatgtgcctacatgtcacagagctaaaggttccttttcattgagcactttggaaactctcttcttgcagaatctgcaaatgtatatttgtgagtgctttgaggcctatggtgaaaaaggaagtatattcacataaaaattagaaagaaggtttctagaaagtactttgtgaggtgtgcattcatttcacagtggcaaacatttcttttcttcgagtagtttggaaactctgtttctctagaacatgcaaagggatatttctgagcgctttgagagctatgttgaaaaaggatatatcttctcataaaaactagacagaagctttctgagaaacttcttagatgtgtgcattcatctcacagtgttgaaccattcttttggttcagcagtttggaaacagtctttttgtcgtatctgcaaagggatatttgtgagcgctttgaggcctatggtgaaaaggaaatatcttcacataataaggagaaagaaggttcctgagaaaatgctttgtgatgtgtgcattcatctcaccgaggtaaacatttgttttcattggtccatttggaaactgtgttcttgtagcatctgcaaagggatatttgtgagcactttgaggtctatggtgaaaaaggagatatcttcacataaaaactagaccgaaggtttctcagaaacttctttgtgaagtgtccattcatctcacagagttaaacctaacttttgattgagcaatttggaaacagtccttttgtactatctgcaaaggaatatttgagagagctttgaggcctgtggtaaaaaggaaatatcttcacataaaagctagagagaagctttcttagaaactgttttgtattgtgtctattcatctcagagaagtaaacgtttcctttcattgagcagtttggaaactctgtccttctagaatcatcaaagggatatttgtgagcactttggggactatggtgaaaaaggaaacattttcacataaaagctagaaagaagttctttgagaaactgctttgtgttgtttccattcatctcagagaagtaaagatttcctttcattgagcagttcggaaattctgtccttcaagaatctgcaaagggacatttgtgagcactttggggcctatggtgaaaaaggaaatatcttcccataaaaactagacagaatctttatgagagactgctttgtgatgtgtgcattcaactcccagagttgaaacattcttttgattgagcagtttgcaaacagtctttttgaagaatctgcaaagggaaatttgtgagcgctttgaggcctttggagaaaaaggaaatgtattcacagaaaaactggaaagaaagcttctgataaactgctttataatgtgtacaatcatttcacagagatcagtgtttcttttcattgagcagcttggaaactatttttgtagaatctgaaaatggatatttttcagtgctttgatgcctgcgttaaaaaaggaattatcttcacataaaaaatagaaaatttctgagaaacttctttgtgatgcatgaatttatgccaccgagttgaaccattttatgattgagcagtttggaaacagtctttttgtggaatctgcaaagagatatttgtgagtgcattgaggcctacagtaaaaaagaaaatatcttcacataaaaactagcaaggagctttctaagaaactgctttgtgatgcgtgcattcatctcacagaggtaaatgtttctttgcattgaacagtgaaaactctgttcttgtagaatctgcaaagtgatatttgtgagtgttttgaggcctatggtgaaaaaggaaatatcttcagaaaaactagacagaagctttctgagaatattctttgtgatatatgcattcatctcaaagaattgaacgacctctttgtttgagcagtttgggaacagcctttttgtagattctgcaaagggatatttgtaagccctttgaggactatggtgaaaacgtaaatatcttcacataactagacagaaggttgctgaaaagctgctttgtgatgtgtgattcacctcaaagaggtcaaagtttcttttcattgagcagattggaaacactgctcttgtagaatctgcaaagggatatatttgagtggtttcaggcctatggtgaaaaaggaaaaatctccacataaaaactagacagaagcattctgaaaaacttgtttgtgattggtgcattcatctcacacagttgaacctcacttttgattgagcagtttggaaacagtctttctgtagaaagtggaaacaaatatttgtgagtggtttgaggcctgtggtgaaaaaggaaatatcctcacataaaaactagacagaaacttcctgagaatcttctttgtgatgtgtgcattcgtctcacagagctgaatatttcttttaattgagcactttggaaatattttttctttttgcaaactggaaagggatattggtgagccctttggggaatatggtgaaaaaggaaataacttcacataaaaactagaaagaaggtttctgagaaactgctttgtgatgtgtgcatttatctcacagaggtaaacttttcttttcattgagcagattggaaactccctacttgtagaatctgcaaagggataattgtgagcactttgaggcctatggtgaaaaaagaaatatcttcacataaaaactagacagaagctttctgagaagctactttgtgaagtgtgcattcatctcacagagttgagcctttcttttgattgagcagtttggaaacagtctttttgtagaatctacaaaggcatatctgtgagtggtttgagacctatggtgaaaaaggaattatcttcatataaaaactagacagaagcttctcagaaacttctttgttatgtgtgcattcatctcacagagttgaaactttctttgattgagcagtttggaaacagtgttttgtagaatctgcaatgggatattggtgagcggtttgaggcccatggtgtaaaaggaaatatcttcacataaaaactagacagaagctttctgagaaacttcttctttgagatgtgtgaattcatctcacagagttgaatctttcttttgattgaacagtttggaaacagtcttttcgtagagccttcaaagggatatttgtgagtgctttgaggcctatggtgaaaaatgaaatatcttcagacaaaaactacagagaagccttctgagaaactactttgtgatgtgtatattcatctcagacagttttaactctcttttccttgagcagcttggaaacagtctttttgttgaatctgaagatggatatttgcgagtggtttgagacatgtggtgaaataggaaatatcttcacataaaaagtagacagaagcttcctgagaaacttctttgtgatgtgtgcattcatctcacagagctgaaattgttttcattgagcagtttggaaacagtctttgtgtagaatcttcaaagggatatttgccagtggtttgaggcctatggggaaaaaggaaatatcttcatataaaactagacagaagctttctgagaaacttccttgtgatgtgtgcattcatctcacagaggtaaacgtttcttttcactgagcagtttgaaaactctgttcttgtagaatctgcacagggataattgtgagcgatttgaggcctgtggtgaaaaatgaaatatcttcacataaaaactagacagatgccttttgggaaactactttatgatgcatgcattcatctcacagaggtgaacgtttcttttaattgagcagtttggaaacagtctttttgtagaatctgtaaagggatatttgtgagtggtttgaggcctatggtgaaaaatgaaatatcttcacatgaaaactagacagaagctttctgagtcaattctttgtgatgtttgttttcatctcacagagttgaaactttcttttgattcagcagtttggggtcagtcttttgtagaatctacaaagggatatttgtgagtcctttgaggcctatggtgaaaaagcaagtatcttcacataaaaactgcacacaagatttgtgagaaactgctttacagtgtgtgcattcatttcacagaagtaaaggtttcttttcattgaacacattggaaactctcttcttgtagaatctgcaaagggatatttatttgtgagcactttgaagcctatggttgaaaagaaatatcttcacagaaaaactagacagaagggtggaaccaagatggctgagtaggaacagctccagtctactgctcccagtgtgagtgatgcagaagaggggtgatttctgcatttccatctgaggtacagggttcatctcactagggagtgccagacagtgggtgcagcacaccgtgtgtgagccaaagcagggcgaggcattgcctcactcgggaagcacaaggagtcagggatttccctttcctagtcaaagaaaggggtgacagacagcacctggaaaatcgggtcactcccaccctaatacagtgcttttccaatgggcttaaaaaacggcacaccaggagattatatcccgcatctggctcagagggacctacgcccacggagtctcaatgattgctagcacagcagtctgagctcacactacaaggtggcagtgaggctggggaaggagctcctgccattgcccaggcttgattaggtaaacaaagcagccaggaagctcgaactgggtggagcccaccacagctcaaggaggcatgcctgcctctgtaggctccacctctgggcggaaatgcacagacaaacaaaaagacagcagtaacacctgtagacttaaatggccctttctgacagctttgaagagagtagtggttctcccagtacgcagctggagatctgagaatgggccgactgtctcctcaagtgggtccttgacccacaagcagcctaagtgggaggcaacccccagtaagggcagactgacacctcacacagctgggtagtcctctgagacaaaacctccagaggaacaatcagccagcagaatttgcgtttcactaagatctgctgttccacagccaccgctgttctgcagccaccgctgctgatatccaggaaaacagtgtctggagtggacctctagcaaactccaacagacctgcagctgagggtcctgtctgttagaaggaaaactaacaaacagaaaggacatccacacaaaaaaatccttctgtacgtcaccatgatcaaagaccaaaagtagataaaaccccaaagatggggaaaaaacagcagaaaaactggaaactctaaaaagcagagcacgtctcctcctccaaaggaatgcagcacctcaccagcaatggaacaaagctggatggagaatgactttgacgagctgtgagaagaagtcttcagatgatcaaactactctgagctacaggaggaaattcaggccaatggcaaagaagttaaaaactttcaaaaaaaattagacgaatggataactagaataaccaatgcagagaagtccttaaaggaactgatggagctgaaagccaaggctcaagaactacgtgaagaatgcagaagcctcaggagccgatgcaatcaactggaagaaaggatatcagtgatggaagacgaaatgaatgcaatgaagcaagcaggaaagtttagataaaaaagaataaaaagaactgaacaaagcctccaagaaatatgggactatgtgaaaagaccaaatctatgtctgattgacgtacctgaaagtaatggggagaatggaaccaagttggaaaacactctgcaggatattatccaggagaacttccccaatctagcaagcaggccaacattcagattcagaaaatacagagaacgacccaaagatactccttgagaagaacaactccaagacacataattctcagattcaccaaagttgaaatgaaggaagaaattttaagggcagccagagagaaaggtcgggttacccacaaagggaagcccatcagagtaacagctgatctctcggcagaaactctacaagccagaagagagtgggggccactattcaacattcttaaagaaaagaattttcaactcagaatttcatatccagccaaactaagcttcataagtgaaagagaaataaaatactttacagacaagtaaatgctgagagattttgtcaccaccaggcatgccctaaaagagctcctgagggaagcactaaacatggaaaggaacaaccggtaccaaccactgcaaaaacatgccaaaatgtaggaccatcaaagctaggaagaaactgtatcacctaatgagcaaaataaccagctaagatcataatgacaggacaaaatacacacataacaacattaactttaaatgtaaataggctaaagtctccaattaaaagacacagactggcaaattggataaagagtcaagacccatcaatgtgctgtattcaggaaacccatctcacatgcagagacacacataggctcaaaataaagggatggaggaagatctaccaagcaaatggaaaaaaaaaaacaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcattaagtgagtccttagtgacctacaaagagacttagactcccacacagtaataatgggagactttagcaccccactgtcaactttagacagatcaacgagacagaaagttaacaaggatacccaagaattgaactcagctctgcaccaagtagacataatagacatctacagaactttccaccccaggtcaacagaatatacgttcttttcagcaccacaccacacctattccaaaattgaccacatagttggaagtaaagcactcctcagcaaatgtaaaagaacagaaattataacaaactgtctttcagaccacagtgcaatcaaattagaactcaagactaagaaactcactcaaaactgctcaactacatggaaacaaaacaacctgctcatgaatgactactgggtacataacaaaatgaaggcagaaaaaaagatgttctttgaaaccaatgagaacaaagatacaacataccagaatctctgggacacattcacagagttgaattttttttcaactttcaagttcacagagttgaacttttcttttgattgagcaatttgggaaaaagtatttttgtagaaactgcaaagggacatttttgagctccttgaggcttatggtgaaaaaggaaacatcttcatataaaaactaaacagaagctttctcagaaacttctttgtgatgtctgcattcatctcagaaagctgaacatttcttttggttgagcagtttagaaaaagtctttttgtagtatctgcaaaggcatatttgtgaacactttgaggcctatggtgaaaaagcaaatatcttcacatagaaactagaaagaaggtttctgagaaactgctttgtgatgtgtgcattcatctcatagatgtaaacgtttcttttcattgagcagattggaaactctgttcttgtagaatctgcaaagggatatttgtgagcactttgaggcctatggtgaaaaaggaaatatcttcacataaaaataagacagaatctttttgagaaacttctttgtgatgtgtgcattcatctcacagatttgaacctttcttttgattgagcactttggaaaccgtctttttgtagcatctgcaaagggatatttctgagcactttgaggcctatggtgaaaaaggaaatatcctcacataaaaaatagaatatttgtgaggaacttcttcgtgatgtgagcattcatgtcagagtgcaactttccttttcttgagccatttgtaaacagtctttttgtagaatcttcaaagggatatttggcaatgctttgattcctatgttgaaaaaggaaatatcttcacataaagactagaaagaagctttgtgagaaacggctttgtgatgtgtgctttcatgtcacagaggtaaacgtttcttttcattgagcaggttggaaactctgttcttctagaatctgcaaagggatatttgtgagcgctttgaagcccatggttaaaaaggatacattttaacataaaaactagacagaagatttctgagaacttctctgtgctgtgtgcattcatttcaaagaggtaaacctttcttttcattgagcaatttggaaactctgttcttctagaatccacaaagggatatttgtgaggaatcaaaaaggaattatcttcacataaaattacacagaagcattctgagaaactgctttgtgatatgtgctttcatctcacagttaagccattcttttgattgagcagtttgggaacagtcttttgtagaatctgaaaggggacatttgggagagatttgaggactacggagaaaaaggatatatcatcacataaaatctagacaggtttctgagatactgctttgtgatgtgtgcattcatttcacagaggtaaatgtttcttttcattgagcagattgggaactcctttctcgtagaaactgcaaagggatatttgtgagtggtttgaggcctatggtgcaaaaggaaatatcttctcataaaaactagacagaagctttctgagaaacttctacatgatgagtgatttcattgcacacagttgaaccatactttttattgagcaagttggaaaccgttttttgtaaaatctgccatgggatatttgtgagtgctttgaggcctatggtgataaagaaaatatcttcacctataaactataaagaaggtttctgagaaactactatgtgatgtgtgcattgatctcacagagtgaaaagttcctttttttgttctgtctggaaactctgttcttgtagagtctgcaaagggatattttttagcaccctgaggcctatggtggaaaaggtaatatcttcacataaaaacaagacagaagcattcttagaaacttctttgggaggagctaagttggctgaataggaacagctccggtctacagctccaagcatgagcaatgcagaagacatgtgatttctgcatttccaactgaagtaccaggttcatctcactggggagtgccagacagtaggtgcaggacacggggtgcagtgcactgtgtgtgagccaatgcagggtaaggaatcacctcagctgggaagcacaagaggtcagggaattccctttcctagtcaaagaaaggggtgacagatggcacctgaaaatcaggtcactcccaccctaatactgcgcttttccaactggcttaaaaaatggcacaccaggagattatatcttgcaacttgctcagaggaacctacacccacagagtcttgctctttgcaagcacagcagtcagagatccaactgcaaggcagcagtgaggctgggggtggggcgcccaccattgctgagttagttgtttgattaggtaaacaaagtggccaggaagctcaaactggatggagcccatcacagctcaaggaggcctgcctgcctctgtaggctccacctctgggtgcagggcacagataaacaaaaagacagcagtaacctctgcagacttaaatgtccctctctgacagctttgaagagagtagtggttgtcccagcatgcagtttgagatctgaaaacgggcagactgcctcctcaagtgggtactgaaccccgagtagcctaactgggaggcacccccagtaggggtggactgacacctcacactgctgggtactcccctcagacaaaacttccagaggaatgatcagacagcagcatttgcagttcaccaatatctgctgttctgcagccaccactgctgatacccaggaaaacagggtctggagtggtcctctagcgaactccaacagacctgggctgagggtcctgtctgttagaaggaaaactaacaaacagaaaggacatctgcatcaaaaacccatgtgtatgtcaccatcgtcaaagaccaaaggtagataaaaccagaaagatgggaaagaaacagagaagaaaaactggaaactctaaaaatcagagtgcctctcctcctacaaaggaatgcagctcctcaccagcaatggaacaaagctggatggagaatgactttgacaagttgacagaagaaggcttcagaatatcaaagaattccgagctacaggaggaaattcgaaccagtggcaaagacgttaaaagctttgaaaaaaaattagataatggataactaaaataaccaatgcagagaagcccttaaaggacttgaaggagctgaaaaccaagggacaagagctatatgatgaatgcagaagcctcaggagctgatgtgatcaactggaagaaagggtatcagtgatggaagataaaacgaatgaaatgaagtgagaagaaaagtttagagaaaaaataaaaagaaatgaacaaagcctctaagaaatatgggactatgtggaaagaccaaatctacgtctgattggtgtaccagaaagtgatggggagaatggaaccaagttggaaaacactctgcaggatattatccaggagaacttccccaatctagcaagacaggccaacattcacattcagaaaatacagagaacgtcacaaagatactcctcaagaagagcaactccaagacacaaaattgtcagattcaccaaagttgaaatgaaggaaaaaatgttaagggcagccagagagaaaggtcgagttacccacaaagggaagcccatcagagtaagagctgatctcttggcagaaactctacaagccagaagagagtggggaccaatattcaccatccttaaagaaaagatttttcaacccagaattccatatccagccaaactaagcttcataagtgaaggagaaataaaatactttgcagagaagcaaatgctgagagattttgtcaccaccaggcctgccctaaaagagctcctgaaggaagcactaaacatggaaaggaacaaccagtaccagctactgaaaaaacatgccgagttgtaaagacgatcatggctaagaagaaactgcatcaactaatgagcaaaataaccagctaacatcataatgacaggatcaaattcacacataacaatattatccttaaatgtaaatgggctaagtgctccaattagaagacacagactggcaaattggataaagagtcaagacccatcagtgtgctgtattcaggaaacccatctcatgtgcagagacacacataggctcaaaataaagggatggaggaagatctaccaagcaaatgggaaacaaaaaaaggcaggggtggcaatcctagtctctgataaaacagactttaaaccaacaaagatcaaaagagacaaagaaggccattacataatggtaaagggatcaattcaacaagaagggctatcctaaatatataagcacccaatacaggagcacccagattgataaagcaagtcctgagtgacctacaaagagacttagactcccacacaataacaatgggagactttaacaccccactgtcaacacttgacagatcaatgagacagaaagttaacaaggatatgcaggaattgaactcacctctgcaccaagcagacctaatagacatctacagaactttccaccccagatcaacagaatatacatttttttcagcaccacaccacacttattccaaaattgagcacatagttggaagtaaagctctcctcagcaaatgtaaaagaacagaaattataacaaactgtctctcagaccacagtgaaatcaaactagaactcaggattaagaaactcactcaaaaccgcttaactatatgtaaacaaaacaacctgctcctgaatgactactgggtacataacgaaatgaaggcagaaataaagatgttctttgaaatcaacaagaacaaagacacaacataccagagtctctgggacacattcaaagaagaatatggagggaaatttatagcactaaatgcccacaagagaaagaaggaaatatctaaatttgacaccctaaaatcacaattaaaagaactagagaagcaagagcaaacacattcaaaagctagcagaacgaaagaaataactaaaatcagagcagaactgaaggaaatagagacacaaaaaacccttcagaaaatcaatgaatcgaggagctgttttttttgaaaagatcaacaaattgatagactgctagcaagactaataaagaagaaaaaagagaagaatcaaatagacgcaataaaaatggacaaagggaatatcaccactgatcccacagaaatataaactaccatcagagaacactataaacacctctgtgcaaataaactagaaaatctagaagaaatggataaactcctcgacacatacaccctcccaattctaaagaaggaagaagttgaatctctgaataggccattaacaagctctgagtttgaggcaataattaatagcatatcaaccaaaaaacgtccacaaccagatggcctcaaagtggaattctaccagaggtacaaggaggagctggtaccattccttctgaaactattacattcaataaaataagagagaatcttctctaactcattttatgaggccaacatcattctgataccaaagcctggtggaggcacagaaaaaaagagaattttagaccaatacccttgatgaacattgattcaaaaatcctcaataaaacactggcaaactgaatcgaggagcacatcaaaaagcttatccaccatgatcaagtaggcttcatccctgggttgcaaggctggttcagcataagaaaatcaataaacgtaatccagcatagaaacagaaccagagacaaaaaccacatgattacctcaatagatgccgaaaagcccgttgacaaaattcaacaacacttcatgctaaaaactctcaaaacattaggtattgatgggacgtaactcaaaataataagagctatctatgacaaacccacagccaatatgataatgaatggacaaaaagtggaagcattccctttgaaaactgacaaaagacagggatgccctctcttaccactcctattcaacatagtgttggaagttctagccagggccatcaggcaggagaaggaaataaagggcattcaatcaggaaaagaggaagtctaattgtccctgtgtgcagatgacacgattgtacatctagaaaaccccattgtctcagcccaaaatctccttaagctgataagcaacttcagcaaagtctcagtatacaaaatcaatgtagaaaaatcacaagcattcttatacacgaataacagacaaacagagagccaaatcatgagtgaactcacattcacaattgcttcaaagagaataaaatgcctaggaatccaacttacaagggatgtgaagacctcttcaaggagaactacaaaccactgctcaatgaaataaaagaggaaacaaacaaatggaagaacattccatgctcatgggtaggaagaatcaatatcgtgaaaatggccatactgcccaaggtaatttatagattcaatgccatccctatgaagctaccaatgactttcttcacagaaatggaaaaactactttaaagttcatatggaaccaaaaaagagcccacatcaccaagtcaatcctaagccaaaagaacaaagctggaggcatcacactacctgacatcaaactatactataagggtacagtaagcaaaacgacatggtactggtaccaaaacagagatatagaccaatggaacagaacagagccctcagaaataatgctgcttatctacaactatctgatctttgacaaacctgacaaaaacaagcaatggggaaaggattccttatttaataaatggcgctgggaaaactgtctagccatgtgtagaaagctgaaactggatcctttccttacaccttatacaaaaattaattcaagatggattaaagacttaaatattagacctaaaaccataaaaatcctagaagaaaacctaggaaatgccattcaggacataggcatgggcaattacttgatgtctaaaacaccaaaagcaatggcaacagaagccaaaattgacaaatgggatctagataaactaaacagcttctgcacagcaaaagaaactaccatcagagtgaacaggcaacctacagaatgggagaaaaattttgcaacctgcttatctgacaaagggctaatatccagaatctgcaatgaactcaaatttacaagaaaagcaaacaaccccatgaaaaagtaggtgaaggatatgaacagacacttctcaaaagaagacatttatgcagccaaaaaacacacgaaaaaatgttcatcataactggccatcagagaaatgcatttcaaaaccacaatgagataccatctcacaccagttataatggtgatcattaaaaagtcaggaaacaacaggtgctggagaggatgtggagaaataggaacacttttacactgttggtgggactgtaaacttgttcagccattgtggacatcagagcagcgattcctcagggatctagaactagaaataccatttgacccagccatcccagtactgggtatatacccaaaggattacaagtcatgctgctttaaagacacatgcacacatatgtttattgtgacactattcacaatagcaaagacttggaccaaacccacatgtccaacaaagatagtctggattaagaaaatgtggcacatattcaccacagaataccatgcagccataaaaaatgatcagttcatgtccattgtagggacatggatgcagctggaaaccattattctcagcaaactatcacaaggacaaaaaaccaagcaccgcatgttctcacccacaggtgggaattgaacaaagggaacacaagggcagaggaaggagaacatcacacaccagggactgttgtggagtggggagagggtggagggatagcattaggagatatacctaatgttaaatgacgagttaatgggtgcagcacaccaacactgcccatttatatgtatgtaacaaacttgcactttgtgcacatgcaccctaaaacttaaagtatgataataataaaatacaatgaaaaaaaaactactcaatcaaaagaatggctcaactcagtaggatgaatgcatgaacacaaagaagtttctcagaaagctttggtctagtttctatgtgaagatatttccttttttaccataggcctcaaagcactcacaaatacccctttgcagattccagaagaacagagtttctaaactactcagtgaaaaggaacttttaccccatgagatgaatgcacacattgcaaaacagtttttcacaatgcttctttgtagtttttatgtgaagctatttcctttttcaccatagtcctcaaagctctcccaaatatccctttgcagattctacaaaaagactgtttccaaactgctcaaagaatggttcaactctgtcagatgaaaccacacgtcacaaagcagtttctcataacgtttctttctagtttttatgtgaagattgtcctttttcaccataagcctcaaagtgctaataaatatccctttgaagattctacaaaaagactgtttccaaactggtcagtcaaaggaatggtctacaaatgtaagatgaatgcacacatgacaaagaagtttctcagaaagcttcggtctagtttttatgtgaagatatttccttttccaccataggcctcaaagcactcacaaatatccctttgcagattctacaagaacagagtttccaaactgctcaatgaaaagaaacatttacctcagtgaaatgaatgcatacatcacaaagaagttaccagaaagcttctgtctagtttttatgttaagatgtatccttttccaccatgggcctcaaagtgctcacaaatatccctttgcagactgtagaagaacagagtttccaacatgcttaatgaaaagaaacgtttacctctgtaacatgaatgcacatatcacaaagcaatttctcacaaatcttctttctagtttttatgtgaagatatttcctctttcaccataggaattaaagtgctcccaaatatccctttgaagattctacaaaaagactgtttccaaatggctcaagcaaaaggaaggttcaactccgtgagatgaatgcacacatgacaaagaagtttctcagaaagtttctgtctagtttttatgtgaagatatctcctttttcaccataggcctcaaagcactcaggaataaccttttgcagattctacaaaaagactgattgcaaactgttcaatcaaaagaaaggttcaactctgttagatgaatgcacacgtcacacagaagtttctcaaaaagattttggcatattttcatgtgaagatatttcctttttcactgtatccctcaaagcactcacaaatatccctttccagattctacaagaacagagtttccaatctgctcaacagaaagagacgtttacctctatgagatgaatgtacacatcacaaagaagtttctcaaaaagattctgtcttatttttatgtgaagatatttcctttttcactgtaggcctcaaagcactcaaaaatatccctttgcagattctacaagaacagagtttccaatctactcaatgaaaagagtcacttacgtctatgagatgaatgcacacatcacaaagcagtttctcagaaaccttctgtctgttttgattgtgaagatatttcctttttcaccataggcctcaaagggctcacaaatatcccttttcagattctacaaaaagactgcttccaaactgctcaatcaaaagaaagttcaaatctgtgagatgaatgcacacatcacaaagaagtttctcagaaagcttccgtcaagttttaatgtgaagagatttccttccttaccataggcctgaaagtgctcactaatatccctttgcagattctacaaaaagaccgtttccaaactgttcaatcaaaagaaagtttcaactccgtgagacgcaagcacacatcacaaagaagatactcagaaagcttctgtctagtttttatgtgaagatatttcctttttcaccataggtctgaaacgcctcacaaatgtccccttgcagtttctacaaaaagactgtttccaaactgctcaatcaaaggaaagtttcaactctgtgacatgaatgcacacatcacaaagaagtttatcaaaaagtttctgtctagtttttatgtgaagacatttcctttttcactataggcctgaaagtactcaaaaatatccctttgcagattctacaaaaagactgtttccaaactggtcaaacaaaagaaagtttcaactctgtgagaagaatgcacacatcacaaaacagtttctcaggcagcttctgtctaattcttaagtgaagatatgtcgtttttcaccatagtcctcaaaccgctcacaaatatccctttgcagatactacaaaaagaccgtttccaaactgttcattcaaaagaaagattcaattctctgagatgaatgcacacatcacaaggaagtttctcagagagcttatgtctagtatttatataaagttatttcctttttcaccataagactcaaggggctcacaaatatcccattgtaatttctacaaaaggactgtttccaaactgctcaattgaaagaaagttttaactctgtgagttgaatgcacacatcacaatgaagtttctgagaaagcttctgtcttgtatttatgtgaagatatttctttttcaccatagacctcaaactgctcacaaatatctctttgcagtttctataaaaagactgtttcaaaacttctcaatcctaagaaagtttcagctctgtgcagtaaatgcatacatcagaaagaactttctcagaaagcttcttcctagtttttatgtgaagttatttccttattcaccataggcctcaaaggcctcaaaaatattcctttccatattttacaaaaagactgtttccaaactgctcaatcaaaagaacgattcaactatttgaaatgaatgcacaaaacacaaggaagtttcttggaaagcttctgtctggtttttatatgaagacatttcttttttcaccatagaccacaaaccactgaaaaatataacgttgcagtttctgcaaaaagactgtatcaaaattgctcaatcgaaagaaagtttaactctgtgagatgaatgcacacatcacaaagaagtttctcagaaagcttctgtctagttttcatgtgaagatatttgctttttcaccataagcttcaaaggccccacaaatatccctttgcagtttctacaaaagactgtttccaaactgctcaatcaaaagaaactttcacctctgtgagatgaatgcacaaataatgaagaagtttctcagaatgcttctgtctactttgtttttgaaggtattactttttcacgataggactcaaactgctcacaaacatcccttgcagtttcttcataaagactctttccaaactgctcaatcaagaaaaggttcaactctatgaggtgaatgcacacatcaaaatgaagtttgtcagaaagcatctgtctggcttttatgtgatgatatttcctttttcaccataggcatcaaaggcatcacaaatatccctttgcagataataaaaaagatggtttccaaactgcacaatcaaaagaaaagttcaactccgtgagatgaatgcacacatcacaaagaagtttctcagagtgattctgtcttgtttttatgtgaagatattcactttttcaacataagactcaaagccctcaaaaatatccattgggagattctataaaaagagattttcaaaacttctcaatcaaaaggaaggtttaacagtgtgagatgaatgcacacatcacaaggatgtttctcagaatgtttatatctaggtttcatatgaagatatttcctttttcaacataggccacaaaccactcacaaatatccctttgtagtttctacaaaaagactgtttccaaactgctcaatcaaaacaaaggttcaaatatgtgagttgaatgcacacatcacatggaagtttctcagaaaccttccatctagtttttttgtgaagatatttctttttcaccataggcctcaattcgctcacaaatatccctttgcagtttgttgaaaaagactccttccaaatttctcaatcaaaaaaatgtttcagctctgtgtgctgaatgcacacatcagaatgaaatttctcagaaagcttctgtctaggttttacgtgaagatatttcctttttcaacataggcctcaaatgtctcacaaaatatttgtcctttccagattctacaaaaagactctttccaaactgctcaatcaaaagaaagcttcaactccgtgaaatgaatgcacacatcactaggatatttctaagaaagcttctgcctaatttttatatgaagtacttcctttttcaccataggcctcaaactgctcacaaatacccctttgcagtttctataaaaagtctgtttccaaactgctcaatggaaacaaaagtttcattctttgagatgaatgtacacatcacaaagaagttcctcagaaagcttattgtctggcttttatgtgaagaaatttcctttttcaccataggcctcaaagtcctcacaaatatccctttgcagattctacaaaaagaatgtttccaaactgttcattcaaaagaaaggttcaactgtgtgagatgaatgcacacatcacaaggaagtttctcagaacgcttatgtcttgtttttatatgaagatatttcctttttcaccagaggccacaaaccactcaaaaatatccctttgagggttctacaaaaagaatgtttgaaaactggtcaatcaaaagaaagtttccactctgtgagctgaatgctcacatcacaaaaaagtttctcagaaagtttctgtctagtttttgtgtgaagatatttcctttttcacaataagcctcaaaccactcacaaatatgtctttccagattctataaaaagacagtttccaaacttctcaatcaaaagaaaggtttaacactgtgagatgaatgcagacatcactaagaagttactcagaaagcttttgtctaattgttatatgaagatatttcctttttcaccataggcctcaaaatgctcacagatatccctttgccgattgtacaaaaggactgtttccaaactgctgaatcaaaagaaagtattaactcggtgagatgaatgcatacatcaaaaagaagtttctgagaaagattctgtctagtttttatgtgaagatatttcctttttcaccataggccttaatggcctcacaaatatccctttccagaatctacaaaaagactgtttccaaactgctcaatcaaaagaaaggttcaactctatgaaataaatgcacaaatcacaaggaagtttctcagaaagtttatgtctaatttttaatgaagacatttcgtttttcaccataggctgcaaatcgctcacaaatatccctttgtagtttctagaaaaagacgatttccaaacagctcaatcaaaagaatcattcaactctatgaggtgaatgcacacatcagaaataactttctgagaaagcttctgtctagtttttatttgaagatatttcctttatctccataggcctcaaagggataccaaatatccctttccagattgtacaaaaagactgtctcctaactgctcaatcaaaagaaagtttcaactctgtgagatgaatgcacacatcacaaagaagtttctcagaaaggttttttcaggggtttatgtgaagatatttcctttttcaccagaggtctcaaagtgccctgaaatatccctttgcagattctacaagaagaatgtttccaaactccacaatcaaaagaaagattcaactttgtcagatgaatgcacacatcacaaagaagtttctcagaaagtttccatatagtttttatttgaagatatttcccttttcaccataggacaaaaaggactcccaaatatccctttgcagattttacaaaaagactgtttcctaactcttcaatccaaagaatggttcaactctgatagatgaatgcacacatcacaaggaagtttctcagaaagcttctctctagtttttatgtgaagatatttcccttttcaccataggcctcaaagggctcccaaatatacctttgcagattctacagaaagatggtttccaaactgctcaatcaaaagaaagtgtaaactctgtgagatgaattcaagcatcacaaaaaagattgtcagaaagcttctgtctagtttttatgtgaagatgtttaccttttcaccatagggctgaaagcaccctcaaatatccctttgcagattctacaaagagtctgtttccaaactcctcaatcaaaagaaaagttgaactctgtcagatgaatgcacacatcacaaacaagtttctcagaaagattctgtgtaatttttatgtgaagatatttactttttcaccacaggcctcaaaccactcagaaatatccctttgcagattttacaaaaagactgtttccaaactgctcaataaaaagaaaggttcaaccctgtgagaagaatgcacaaatcacaaataaattcttcagaagacttctgtctagtttttatgtgaagatattccctttttcaccttaggtctcaaaaagctcagaattataactttgaagattctagaaaaagactgtttcccaactgctcaatcaaaataaaggatcaactctgtgagatgaatgcacacatcacaaagagattcttataaagtttctgtctagtttttgtgtgaagatatttctttattcaccataggcttcaaatggctcagaaatatccttttgcagattctacagaaggacagtttccaaactgctcaatcaaaagaaaggttcaaatctgtgagatgaatgcaaacatgtcaaaaaagtttctcagaaagcttctgtctagtgtttatatgaagatatttcctttttcaccatagaactgaaaccgctcacaagtatacttttgcagattcttcaaaaagagtgtttccaaactgcaaaatcaatggaaagtttcaactctgtgagatgaatgcacacatcacagagaagtttctcagaatgcttctgtctagtttttatgtgaagatatttcccttttcaccataagcctcaaaggaataccaaaatacaccttagcagattctacagaaagactgtttccaaactgctccatcaaaagaaaagttcaactctgtctgattaattcacacatcacaaagaagtttctcagaaagcttgtgtataatttttatgtgaagatatttcttttttcaccacaggcctcaaacagctcagaaatattcctttgcaaattttacaaaaagactgtttccaaactcctcaatgaaaacaaagtttgaactctgtgagatgaatgcacacatcacaaagaagtttctcagaatgtttctgtctggtttttatgtgaagatattcaatttttcaacatggacacaaagggatcccaaatatcatttgcagaatctacaaaaagactgtttccaaactgtttaatcaaaagaaatgttgaactctttgagatgaatgcacgcatcacaaagaagtttctcagaacgcttctgttttgtttttatgtgaagatattccctttttcaacacaggtctcaaagcgccctcaaatatccctttgcagattctacaaaaaggctgtttccaaactgctcaatgaaaagaaaaattcaactgtgtgagatgaatgtacacatcaaaaaaagttcctcagaaagcgtctgtctagtttttatgtgaagatatttcctttttcaccataggcctcaaagggatcccaaatattctgctgcagtttctacaaaaagactgtttccaaactgctcaatcaaaagtaaagttcagcactgtgagttgaattcacacattccaaagaagattctcagaaagcttctgtctagtttttacgtgaagatatttcctttttcaccagaggcctcaaagtgcccccaaatatcactttgcagattctacaaaaagaatgttcctgcactgctcaataaaacaaaagtttaactctgtaatttgaatacaaacatctcaaagaagtttctcagaatgcttctgaatgtttttatgggaagatatttcctttttcaccataggcttcaaaccacacagaaatatcccttagtagattctacaaaaacactgttagaaaactgcacaatcaaaagaaaggttcaactcagtgagataaatgcacacatcacaaaggagattctcaggaagcttttgtctagtttttatgtgaagatatttccttattcaccttaagcctcaaatcactcagaaatatccctttgcagattctagaaaaatacattttccaaactgctcaatgaaaggaatggttcaactctatgagatgaatgcacatatcacaaggaagttcctaataaagtttctgtctactttttatgtgaagatatttcctttttcaccgtgggcctcaatccactcagaaacatcccttagaagattctacaaaaagactgtttccaaactcctcaatcaaaagaaaattgcaaatctgagagatgaatgcacacatcaccaagaattttctcaaaaagctcctgtccagtttttatatgaacatatttccactttcaccatagacctcaaagggctaacaggtatcactttgcagattctacaataaactttccaaactgctcaatcaaaccaaaagttcaacactgtgagttgaatgcacacatcacaaagtagtttctcagaatgcttctgtctaatttttatttgaagatatttccttattcaccgtaggcctcaaattgctcagaaatatccctttgcagattgtagaaacagactgtttccaaactgctccatcaaaagaaagataaaactgtcagatgaatgcacatatgacaaagaagtttctcagaaagcttctgtctagtttttatgtgtacatatttccattttcactgcaggcctcaaagggctcacaaatatcccttttcatattctacaaaaagacattccacactgctcaatcaaaagaaaagttcaactctgtgagttgaatgcacacatcacaaagaagtttctcagaaagcttctgtctagtttttatgtgaagatatttccttattcaccataggcctcaaactgctctgaaatatccctttgcagattgtagaaaaagactgtttccaaactgctcaaacaaaagaaaggtcaaactgtgtgagatgaatgcacacatcaaaaagaagtttcacagaaagctagtttttaagtgaagatattcctttttctccataggcctcaaaggtttccaaaattcccctttgcagatactaaaaaagactgtttccaaactgctcaataaaaagaaaaattcaactctatgagtagaatgcaaacatcaaaaagaagttgctcagaaagtttctgtatactttatatgtgaagttatttccttattcaccatagtcctcaatccgctcagaaatatccctttgcagattctagaaaaagactgtttccaaactgctcaatcaaaagaaaggtccagctctatgagatgaatgcacacataacaaagaagtttctcagaaagcttttgtctagttttttgtgaaggtatttcctttttcaccataggcctccatccgctcagaaatgtccctttgcagattctacaaaaagactgttgaaaaactgctagatcaaaagaaatgttcaactttgtgagatgaatgcacacatctcaaagaagtttctcagaaaacttttgtctagtttttatgtgaagatattccctttttcaccagagacctcaaagggatcccaaatatccctttgcaggttctccaaaaagactgtttccaaactgctcaatcaaaaggaatgttcaacactgtgagctgaaggcacccatcacaaagaagtttctcagaaagcgtctgtctagttttttgtgaacatattttccttttcaccataggcctcaaagggctcccagatttccctttgcagattctacaaaaagattgtatccaaactgctcaatcagagaaactttcaacattgtgagatgaatgtacacatcacaaagaagtttctcagaaagctctgtctagtttttatgttaagatatttcctttttcatcataggcctcaaagggctcccaaacatccctttgtagattctagaaaaagactgtttccaaactgcgcagtcaaaagaaaatttcaactctgtgagatgaatgcatgcatcacagagaagtttctcagagagcttctgtctactttttatgtgaagatatttcctattccaccataggcctcaatgcgcccataagtgtccctttgcagattctacaaaaagtatttccaaactgctcaatgaaaagaaaaattcaactgtgtgagatgaatgcacacatcaaaaaaagttcctcagaaagcgtctgtctagtttttatgtgaagatatttcctttttcaccataggcctcgaagggctccaaaatatccatttgcagattctacaaaaagactatttccaaactgctaaatgaaaagtagggttcaactggtggagaggaatgcacacatcaccaagaagtttatcagaaagtttctatttttttgtgacgatatttcctttttcaccataggcctgaaactgctcagaaatatcccttttcagattctacaaaaagactgtttccaaactaatcaatgaaaagaaagtttcaactccgtgagatgaatgcacagatcacaaagaagcttctcagaaagcttctgtctagtttttagttgaacatatttcctttttcaacaaaggcctcaaactgctcagaaatatccccttgcagattctagaaaaagagtgtttccatactgttgaatcaaaagaaaggttcaactctgtgagatgaatgcacacatcacaacgatgtttctcagaaacttccctctggtttttatatgaagatattactttttcaccataggcctcaaactgctcagaaatatccctttgcagattctagaaaaagactgtttccaaactgctccatcaaatgaaaggttcaactctgtgagatgaatgcactgatttcaaagaagtttctcagaaatattctgtctagtttttatatgaagatatttactttttcaccatacgcctcaaagcactcagaaatatctgtttgcagatttgacaaagagactgtttccaaactgctcaatcaaaagaaaggttcagcactttgagatgaaggcacacatcacaaagaagtttctcagaaagcttctgtctagtttttatgtgaagacatttcctttttcaccataaggctcaaaacgctcagaaatatccctttgcagattgtacaaaaagactgtttccaaaatgctcaatcaaagaaaaggttccactctgtgagatgaatgcacacattagaaataagtttctgagaaagcttctgtctagtatttttgtgaagatatttcctttttcaccataagcctcaaagggaatccaaatatccctttgccgattctacaaaaatattgtttccaaactgctcattcaatagaaaatttcaactctgtgagttgaatgttcacatcacaaggaagtttctcagaaagcttccgtctagtttttatgtgaagatatttccttactcactgtaggcctcaaaatgctcagaaatatccctttgtagattctagaaaaatacttttcacaaactgctcaatcaaaagaaaagttcaactctgtgggagaatgcacacatccaaagaagtttctcggaaagattctgtctagtttttatttgaagatattacctttttcaccatgggcttcaaggggctcccaaatatccctttgcagattctacaaaaagacagtttccaaactgtttaatcaaaagaaagtttcaaatctgtgagatgaatgcacgtatcacaaagaagtttctcagaaagcttctggctattttttatgtgaagatatttcctttttcaccataggccccaaagagttcctaaacatccctttgcattttatacaaaaggagtgtttccaaactgtactatcaaaagaaaatttgaactccatgagatgaatgcacatctcacaaagaagtttctcagaaatcttctgtctagattttatgtgaaaatatttcctttttcaccataggcctcaaagcgcccagaaatttccctttgcagattctacagaaagggtatttccaaactactcaatcaaaagaaaggttcaacactgtgagatgaatgcactcattgaaaagaagtttgtcagaaatcttctgtctagtttttatgtgaagatatttccttttcagctataggcctcaaagcgctccaaatatccatttgcagttactacaaaacgagtgtttccaaactgctcaatcaaaagaaaagttcaacactgtgagataaatgcactcattacaaagaagtttctcagaaatcttctgtccagtttttatgtgaagatatttcctgttttaccataggcctcaaacagctcagagatgtccctttgcagattgttcaagaggactgtttccaaactgctcaatcaaaagaaaatttcacctccgtgagatgaatgtatgcatcacaaagaaattgctaggaaaatttctatctagtttttatgtgaagatatttcttttttcaccatagaacccaaagtgatctcaaataacccttagcagaatccacaaaaatactgtttccaaactgctcattgaaaacaaaatttcaaatctgtgagttgaatgcacacatcacaaggaagtttatcagaaagcttttgtctagtttttatgtgaagatatttccttgttcaccataggcctcaaactgctcagaaatatccctttgcagattctacaaaaagactctttccaaactgataaaacaaaagaaagattcaactctgtgacatgaatgcacacatgtcaaagatgtttctcagaaaacttttgtctagtttttatattacgttatttcctttttctccataggcctcaaacctttcagaaatatccctttgcagattctacaaaaagactgtttccaaactgctcaatcaaaagaaaggttcaactatgtgagatgaaagcacatatcccaaagaagtttctgagaaagcttgtgtctagcttttttttttttttttttgagacggagtctcactctgtcacctaggctggagtgcagtggcgtgatcttggctcactgcaagctccgcctcccatgttcacaccattttcctgcctcagcctcccgagtagctgggactacaggcacccaccactacacccggctaactttttgtatttttagtagagacagggtttcaccgcggtctcgatctcctgacctcgtgatccatgtgcctcggcctcccaaagtgctggaattacaggcatgagccaccgtgcccgtccgtgtctagcttttatgtgaagatatttactttttcagcataggcctcaaagggcttccatgtatccctttgcaacttcaacaaaaagactgtttccaaactgttcaatcaaaacaaaggatcaactctgtgagatgagtgcacacatccaaagaagttcctcagaaagcttctgtgtagtttttatgtgaagacattttcattttcaccataggcctcaaagggatcccaaatatccctttgcagaatctacaacaatactgtttccaaactgctcattgaaaacaaaatttcaaatctgtgtgttgaatgcacacatcacaaggaagattatcaggaagtttctgtttagtttttatgtgaaaatgtttccttattcaccataggcctcaaacggctcagaaatatccccttgcagattctagaaaaagactgtttccaaactactcaatcaaaagaaagtttgaactctgtgagatgaatgtatgcatcacaaagcagttgctcagatagtttctttctagtttttatgtgaagatatttcctttttctccatatgcctcaaagcaccctcaaaaatccctttgcagattccacaaaaagactgtttccaaactgctcaatgaaaagaaatgttcaactccgtgagaagaatgcacacatcataaagaagtttctcagaaagctcctgtctagtgtttaggtgaacatatttcctttttcaccataggcctgaaagcaatcagaaatatcacattgcagattctagaaaaagactctttccaaaatgctcaatcaaaaggaagtttcaactctgtgagatgaatgcacacattacaaagaagtttctcaggaagcttctgtctattttttatatgaagatatttcctttttcaccataggcctcaaacagctgagaagtatcccttagcagatcctataaaatgcctgtttccgaactgctcaatcaaaagaaagtttcaactctgtgagatgaatgcacacatcacaaagatgtttctgagaaagattctgtctacgttttaggtgatgatattttcttttttgccatggggctcaaggggttcctaaatatccctttgcagattctacaaaaagactgtatctaaactgttcaatcaaaagtaaggttcaactctgtgagatgaatgcacacatcaaaaagaagtttctcagaaatcttctgtctattttttatctgaagatatttcctttccatggtaggcctcatagcaccctgaagtgtcccttagcagattctacaagaagactgtttccaaactgctcaataaaaagaaaatttcaactctttgagatgaatgtatacattacaaagacgtttctcagaaagcttctgtctactatttatgtgaagatatttcctttttcaccatatgcctcgaagggcttccaaatgtccctttgcagattctacaaaaagactgtttccaaactgctcaatcaaaagaaaggttcaactctgtgagatgaatgcacacatcacaaagtttctcagaaagcttctttctgtttttctgtgaggatatttcctttttcaccataggcctcaaaccgctcagaatatcactttgcagattgaaaagaagactgtctccaaactgctcaaccaaaagaaagtttcaactctgagatgaattcatggataacagaaacgtttctcagaaagcttctatctagtttttatttgaagatatttccttttccaccataggcctctaaacgctacaaatatccactttcagattttccaaaaagagtgtttcaaaactgctcaatcaaaagaaaatttcaattctgtgagatgaatgcacgtaccacaaagaagtatctcagaatgcttctctgtagttattatgtgaagatatttcatttttcaccatttgcctcaaagggctcccacacatccctttggaaattctacaaaaagactgttcccaaactgctcaaccaaaagaaagtttgaactccatgagatgaatgtacacatcacaaagaagttgctcagaaagcttctgtgtagtttttatgtgaagatatttcctttttcaacataggtctcaaactgctcagaaatatccatttgcagattctacaaaaagatggtttcccaactgttaatcaaaagaaaggttcagctcttggagatgaatacacacatcacaaagaagtttctcagaaaacttctgtctagattttatgtgaatatatttcattttcaccataggcctcaaagggatggcaaatgtcagttcgcagattttacaaaaagactgcttcaaaactgcccaatcaaaagaaaagttgaactctctgagatgaattgacacatcacaaagaagttcctcagaaagcttctgtctattttttatgtgaagatatttcctttttttcaccttaggcctcaaattgctgaggaatatccctttgcagattctagaaaaagactgtttccaaagtgctcaatcaaaagaaacgttcaactctgtgagatgaatgcacacatcacacagaagttcctgagaaatattctgtctagtttttatgtgaatatatatcctttttcaccatagtcctcaaagggctccaaaatatccctttgcagattatagaaaaagactgtttccaaaatgctcaatcaaaagaaaggttcaactctgtgagatgtatgcacacataacaaagaagtttctcagaatgtttctgtctagtttttatgttgagatatttcctttttcaacataggccacaaacagctcacaaaaatcacttgtagatggttgaaaaagactgtttccaaactactcagtcaaaaggaagtttcaactctgtgagatgaatgcatacatcaaaaagtagcttctcagaaagcttctgtatagtttttatgtgaagatatttcctttttcaccttaggccacaaatatctcagaaacatccctttgcgtattctaaaaagactgtttccaaactgctcaatcaaaaataggttcacatcttctagatgaatgcataaaccacaaaacaatttctgagaaaaaaatcggtctagtttttatgtgaagtaaatttctttttcaaaataggcctcaaacatttcccaaatatccctttgccgattgtagaaaaagagtgctttgaaactgcttgatcaaaagaaaggttcaattctgtgggatgaatacacacatcacaaagaagtttctgagaaggcttctgactagtttttctgtgaagatatttcctttttcaccataggcctcaaagggttcccaaatatccctttgcagatactacaaaaactctttccaaactgctcaatcaaaagaaagtttcaactctgtgagttgaatgcaaagattacaaagaagtttctcagaagacttctgtctagttttttgtcagggtatttcctttttcaccataggcctcaaaccactgagaaatatccctttgcagattctacaaaaagactgtttccaaactgctcaatcaaaagaagtttcaactctgtgagatgaatgctcgcatcacaaataagtttttcagaaagattctgtctagtttgtatgtgaagatatttcatttctcaaaataggcccaaaaatgctgtcaaatatctctttgcggattctacagaaagactgttttgacactgctcaatcaaataaagtttcaactctgtcagttgaaggaacacaaaacaaagaagtttctcagaaagcttctgtctagtttttacgtgaagatacttcctttttcaccataagccccacaccgcgtagaaatattcctttgcagatcccacaaaaagactgtttccaaactgtgcaatcaaaagaaagttgcaacactgtgagatgaatgcacacttcttcaaatctgtgagatgaatgcacacatcacaaagaagtttctcagaaagcttctgtctagtttttttgtgaagatatttactttatcaccgtaggcctcaaaccactcagaaatatttctttgcagactttacaaaaagactgtttccaacctgctcaatcaaaagaaagtttctaccctgtgagatgaatgcacacattccaaagaagtttctgagaaagcttctgtctggtttttatgtgaagatattttctttttcaccacaggcctcaaagggctcccaaatatccctttgcagattctacaaaaaaaaaactctttctaaactgctcaatcaaaagaatatttcaactctgtgacatgaatacacgcatcacaaataaatatctcagaaagcttctgtctagtttttatataaatatatttcccttttcgccataggcctcaaaggtctcccaaatgtccctttgcagattctataaaaagaatgtttccaaaccgctaattcaaaaaaatgttcaacattgtgagatgaatgcacttatcacaaagtagtttctcagaaagcttctgtctggtttttatgtgaagacatttcctttttcaccacaggtctcaaacatgtcagaaatatccctttgcagactgtacaaaaagagtctttccatactgctcaatcaaaagaaagtttcatctctgtgagatgaattcatacatcttcaaatctgtgagatgaatgcacacatcacaaagaagtttctcagaaagcttctgtctggtttttatgtgaagacatttcctttttcaccacaggtctcaaacatgtcagaaatatccctttgcagactctacaaaaagagtctttccatactgctcaatgaaaagaaagtttcatctctgtgagatgaattcacacatcttcaaatctgtgagatgaatgcacacatcacaaagaagtttctaagaaagcttctctctagtttttatgtgaagatatttacattttagtatagacctcaaagcctcctcaaatatccctttgctgattcaacaaaatgattgtttccaagctgctcaatgaaaagaaaggttgaactctgtgaggtgaaagcacacatcacaaagtagtttctcagaaatcttctttctagtttttatatgaagatattccctttctcaccatgggcctcaaaggtatcccaattatccctgtgcagatgctacaaaaagatggtttccaaactcctcaatcaaaagcaaggttcaactctgtgaaaggaatgcaagcatcacaaataatttactcagaaatcttctgtctagtttttatgtgaagatatttcctttttcaccattgacctcaaatgtctcccaaatatccctttgcagattttacaaaaaggatgtttccaaactgctcaatcaaaacaaagtttcaactctgtgagatgaatgcatgcaatggaaagaagattctcagtaagcttctgtctagtttttatgtgtatatatctcctttttcaccataggcctcacagggatccaaaatatccccttgcagattttacaaacagacagtttccacaccggtctacgaaaagataggctcatctctgtgtgatgaatgcacacatcaccaagaagttttgcataaagcttctctctagttttattgtgaagatatttcatttttcaccataggcctcaaagcaacctcaagtatccctttgcagattctacaaaaagacataagctgctaaatcaaaagaacgtttcacctctgtgagatgaatgcacacatcacaaagaagtttctcagaaatcttcggtccagtttttatgtgaagatatttcccttttcaccataggcctctaagggcactcaaatattcctttgcagagtctacaaaagacagtttccaaactgctcaatcaaaagaatggttcaactctgtgggatgaatgcaagcatcacaaagaagtttcttagaaagcttctgtctagtttttatgtgaagataattcctttttcaccacaggcctctaagggatcccaaatatccctttgcagattttacaaaaagactgtttccaaactgctcaatcaaaagaaagatttaactctgtgagatgaatgcatgcatcacaaagaaattttgcagaaaatttctgtctaatttttatgtgaagatatttcctttttcaacatagaccacaatgcaccctaaatatccctttgcagattctataaaaagactgtttccaagctgctcaatcaaaagaatggttcaactctgtgagatgaatgcacgtatgacaaagaagtttttcagaaagcgtctgtctgtttttttgcaaagatatttcctttatcaatatatgcctaaaatcgctcagaaatacccctttgcagattctacaaaaagactatttctaaactgctcaatcaaaagaaagtttaaaatctgtgaggtgaatgcacacatcacaaagaagtttttcagaaagctgctgtctagttatcatatgaagatatttcctttttcaccataggcctcaaagtgacatgaaatatcacttttcagattccaaaaaagattgttgccaacctgctcaatcaaaagaaaggttcaaatctgcgagatgaatgcacacatcacaaaagggtatcctagataatttctgtttagtttttatgtgaagataaatccttttcaaaataggcatcaaagggctcccaaatatccctttacagattgtagcaaagcaatgattccaaactgttcaatccaaagaaatatttaacactgtgagatgaaagctcacatcacaaagaaacttatgagaaatcttctgtctggtttttatgtgaagttatttccttttccaccgtaggcctcaagggactcccaaatatcccattgcagatactacaaaaagactgtttccaaactgttcaatcaaaaaaaagtttcaactatgtgtgatgaatgcaggcatcacaaagatgtttttcagaaagcttctctctagtttttatgtgaagatatttcttattcaccataggcctcaaagggctcccaaatatccctttgcagattctacaaaaatactgtttccaaactgctcaattgaaagaaagtttctactctgtgagatgaatgcacacatctcaaagaagtttctgagaaagcatctgtccgatatttacatgacgatatctccattttcaccatagacctcaaaggtctcccaaatatccctttgcaagctctacaaaaagactgtttccaaactgctgtatcgaaagaaaggttcaactgtgtgagatgaatgcacacatcacaaagaagtttctcagaaagcttctgtgaagttttcatttgaagatatttcctttttcaccataggcctcaaatcactcagatataaccctttgcagattctacaaaaagaaggtttccaaactgctcaatcaaaagaatggttcaactctgtgagatgaatggaaaaattaacaagaagtttctcagaatgtttctgtctagtttttatgtgaagatatttcctttttcaccacaggcatcaaagggataccaaatatccatttgcagattctacaaaaagatggtttccaaactgctctatcaaaagaaaggttcaactctgtgagatgaattcacgtatcacaaagaagttactcagaatgattttgtctagcttttatgtgaaggtacttccttttttaccgtaggcttcaatccactcagaaatatccctttgcagattctacaaaaagacggtttccaaactgctcaatcaaaagaatagttcaagtgtgggagatgaatgcacccatcacaaagaagtttctcaggaagtttctgtctagtttttatgtgaagatatttcatttttttcacattaggcctcaaaccgctcagaaatatcactttgaagattatccaaaaagactgtttccaaacttctcaatgaaaggaaaagttcaactgtgtgatatgaatgctcacatcactaggaagtttctcagaaagcttctgtctagtttccatgtgatgatatttcctttttcaaagtatgccacgatccgctctgaaatatccatttgcagattctacaaatagatggtttccaagcttctcaatcaaaagaaatgttcaaatctgtgagattaatgtacgcatcccaaagaagtttctgagaaagtttctgtctagtttttatatgaagatatttcctttttcaccataggcctcaaagagcttccaaatatccctttacatatcctacaaaaagaatgtctccatactgctcaataaaaaaagattcaactctgtgagatgaatgcacacatcacaaggaagtttctcagaaaatttcagtctagtttttatgtgaagatatttcctgtttcatcatagtcctcaaaccactccaaaatatccctttgcagattctacaaaaagactgtgtccaaactgttccatcaaaagaaagtttcaactctgtgagatgtatgcacacagcacaaagaagtttctcagaaagtttctctctagtttttatgtgaagatatttcctttttcaccataggcctcaaagctccctttaatatcaccttgcatcttcctcaaaaagtatgtttccaaatcactccatcaaaggaaagtttcaactcggcgagatgaattcacacatcaaaaaagagtttctcatcaagtttctgtctagtttttatgtgaagataattactttttcaatataggcctcaaagggctcccaaatatccctttacagattctagaaaaggactgtttccaaactgctcaatcaaaagaaaggttaaagtctgtgaggtgaatgcacacatcgcaaagatgtttctcagaaagtttctgtctggtttctgtccgtttttcacagtgggcttcaaagggatccctaacatccctttccagattcaagaaaaagactgtttccaaactgctcaatcaaaagaaattttcaactctgagttgaatgcacacatcacaaagaagtttctcagaaaccttctgtcaagtttttatgcatagttatttcctttttcaccatagaactcaaagggctccaaaatatcttttgcagattctacaaaaagactgtttccaaactgctcaataaaaagaaagtttcaactctatgatatgaatgcacatatcacaaagaagttcctcagaaagcttctgtctagtttttatgtgaagatatttcctttttcaccataggacttgaagggctgctgaatatcctttacagattctaaaaaaagactgtttccaaactgctgaattaaaagaaagtttcaactctgcgagatgaatgcacacatcacaaagaagattctcagaaagattctttctagttttttgcaaagatacttcctttttcacaataggcctcaaactgctcagaaatgtcaccttgcagattctaccaagagaccgtttccaaactgctcaatcaaaagaaagtttctactctctgagatgaatgcattcatcacaaagcagtttctcagaatgcttctgtctagtttttatgtgaagatatttcctttttcaccatagacctcaaaccgctctgaaatatccctttgcagattttagaaaaagacagcatccaaactgctcaactgaaagaaaggtccaactctgcgggatgaatgcaaacatcacaaaagagtatctcagcaaatttctgtctagttttaaagtgaagataactcctttttcaatgggggcttaaaaggggtcccaaatatccctttgcagattgtagaaaaggactgtttcaaaactgctcaatcaaaatatatatccaactctgttagaggaatgcacatatcaaaaagaggttcttcagaaagcttctgtctagtttctatgtgaagatatttcctttttcaccataggcctagaagggctccaaatatccctttgcagattctacaaaaagactgtttccaaactgctcaagcaaaataaaagttcaactctgtgagatgaatgcactcattacacagaagttactcagaaatcttctgtctaatttgtatgtgaaggtatttcctttttcaccataggcctcaaagggctcccaattatcaatttgtggattctacaaaaagactgtatccaaactgctcaatcaaaagaaaggttcaactcttctagatgaatgtacacatcataaaagagtttctcagaaaaattttatctagtttttatgtgaagataatttctttttcaaaataggcctcaaagggctcccgaatatcactttgctgattctagaaaggactgtttccaaactgctcaatgaaaagaaaatttcaactctttgacatgaatgcacacatcacaaagaagtttctcagaaagcttctgtctaggttttatgtgaagatatttcctttttcaccatagccctcaaagcaccctcaaatatcactttgcagattccacaaaaagaatctttctaaacagctcaatcaaaaggaagattgaactctgtgagatgaatgcaaacatcacaaagaagttcctcagaaagcttctttgtaatttttatgtgaaggtatttcctttttcaccacagggttcgaagggctcccaaatatcctttgcagatactacaaaaagactgtttccaaactgctcaattaaaaggaaaggttcaactctgtgagatgaatgcaaacatcagacagaagtttctcagaaagcttctgtctagttttttgcaaagatattttctttttcaccataggcctcagaccactcagtagaatccctttgaagattctaccaaaagattgtttccaaaatgttcaattaaaagaaagtttcaactctgtgagatgagtgcaaccatcacaaagaggtttctcagaaagcttctgtgtagtttttatgtgaaaatatttccattttcaccctaagcctcaaactgttctgaaatatctctttgcggattctagaaaaagactgtttccaaactgttgaatcaaaagaaacattcaaccccacgagatgaatgcacatatcacaaaagagtatctcagaaaatttctgtctagttttaaagtgaagataactgctttttcaatgtaggcctcaaaggggtcccaaatatccctttgcagtttctataaaaagaatatttccaaccttttcaatcaaaagaaaggtgcaactctatgagatgaatgcacacatcataaagaactttctcagaaagcttctgtctactttttatctgaagatatttcctttttcacagtagatctcaaagggctcccaaataccactttgcagattccacaaaacgactgcctccaaactgctcaatcaaaagaaatgttcaattctgtaagatgaatgaacacatcataaagaagtttctcagacgcatctctctgttttttatatgaagatatttactttttcatcataggcctcaaacagctcagaaatatccctttgcagattctgcaaaaagaatgtttccaaagtgctcaatcaaaagaaaaggtcagtattgtgagatgaatgcatgcatcacaatgcagtttctcagaaagcttctgtctagtttttgtgtgaaggtatttcctttttcaccataggcctcaaagtgccctcaaatatcacttcgcagatcctagaaaaatactgtttcaaaaactgctcaatcataaaaagttcaactctgtgagataaatgcacacatcacaaacaagattctcagaaaggttctgtctacattttatgtgaagatatttcctttttcacagtaagcctccaagggttccaaaatatccctttgcatgttgtccataaagaatgtttccaagctgctcaatcaaaagaaagtttcaactctgagatgaatggacacgtcacaaattagtttctcagaaagattctacttagtttttatgtgaagatatttcctttttcaccataggcctgaatcctctgcataatatacctttgcaggtactacatatagactgtttcaaaactggtcaatcaaaagaaaatttcaaatctgtgagatgaatgtgctcatcaaaaagaagtttctccaaatgtttatgtctagtttttatgtgaagatatttccttctttacaataagctgcaaatggatcccaactatccctttgtagattttatgaaagccttttccaagctgctcaatcaaaagaaaagttcaactctgtgagatgaatgtacacaatccaaagtagtttctcagaaaacttctgtctagttttcatgtgaagatatttcctttttcaccatatgcctcaaagggctccaaatatccctttgcagattctacaaaaagattctttccaaactgctcaatcaaaagaaagtttcaactctgtgagatgaatgcatacatcataaagaagtttcacagacagcatctgactagtttttatatgaagatatttcctttttcacaataggcctcaaatcgctcaaaaatatcttttggagattctacaaaaaagactttccaaactgctccaccaaaagaaatattcaactctgtgaggtgaatgcatgcattacaaagaagcttctcagaaagcttctctttagtttttatgtgaagatattccctttttcatcattggactcaaaggattacaaatatccctttgcagattctacaaaagaactgtttctaaactgctcaatcaaaagaaaggttcaaacatgtgaagtgactgcaagcatcactaaggggtttctcaggaagcttctgtctagtttttatgtgaacatatttcctttttcagcataggcctcaaagcaccctgaaatatcactttgcagattctacaaaaagactgtctccaagctgctcaagcaaaagaaattttcaactctgtgaaatgaatgcacacatcacaaagaagtttttcagaaagcttctgtctagtttttatgtgaagataattcctttttcaccataggcctcaaagagctcccaaatatccctttgtagattacacaaaaagacagtttccaaacggctcattcaaaagaaagtttcaaatctgtgagatgaatgcacaaatcacatagaagtttctcagaaagcttctgtctagtttttatgtgaagatattttctttttcaccataggcctcaaagtgcccccagatatctgttgcagattccacaaaaggactctttccaacctgctcaatcaaaagaaaagttcaactctatgagacgaatgcacttatcacaaagaagtttctcagaaagcttccgtctagttttcatgcgaagatatttcctttttcaccattggcttcaaactgctcagaaatatccctttgcagattctacaaaaagactgtttccaaactactcaatcaatagaaatgttcaactctgtgagataaatgtgcacatcacaaaaaagtttctcagaaagcttctgtctactttttatgtgaagatatttcctttttcatcataggcctcaaacggcttagaaatatccgtttgcagattctacaaaaagactgtttctaaactgctcaatcaaaagaaattttcatctctctgagatgaatgcacacatcacaaagacgtttttcagaaagcttctgtctaatttttatatgaagatatttgtttttttaccatgggcctcaaagggatcccaaatatccctttgcagattttacaaaaagactgtttccaaactgctgaatcaaaagaaaggttcaactctgtgaaatggatatacacatcacaaagaagttcctcagaatacttgtgtctagtttttgtgtgaagatgtttcctttttcatgataggaatcgaagggctcctaaatatccatttgaagattctacaaaacactgtttccaaacttcttaatcaaaagaaagtttcaacaccgtgagatgaatgcacacatcaaaagaagttcctcagaaagcttctgcctagtttttttgtgaagatatttcctttttcaccacaggcctcaaaaggctcagaaatatcctcttgcggattctagaaaaatactatttccaaactcctcaatcaaagaaaggttcaactgtgtcaaatgaatgcatgcatcacaaagaagtttctgagaaatcttctgtctagtttttacgtgaagataattcttttcaccatagacctcaaggcgacctcaaatgtccctttgccgattctacaaaatgactgtttccaaactgctcaatcaaaagaaaatttaaattctgtgagatgaatgcacagatcacacagaagttcctcgaaaagtttctgtctagtttttatgtgaagatatttccttttcaccgtaggcctcgaagggctaccaaatatccctttgcagattctacaaaaagactgtttctaaactgctccatgaaaagaaagtttccaatctgtgacatgaatacacacataacaaaagatgttctaagaatatttctgtctagtttttatgtgaagatgtttcgtttttcaccatagacctcgaaggactcccaaatatcccttttcaaattctgcaaaaagacttttttgtagttttttttcattccaccaaattttattgatcactttttctgtatgagatatgatttctgaattcaaagtgattatggcccaaagagtgggatgcacatataaattatcaccacacaggggtcatattataattatcactgaaaggctagaaaagctcacaaggaataaatcagaagagtttcatactgaacagaccatgaaaggctaacaacaaagatggcctctgaccttgacccggaaaccacaacaggagttttgaagataacagcaaaatgtggaaagaatttcagtaggaggataaaatagcatttgtattcacataggagaaggaaataggagcttgaaaaaaaaattgtcaccaagcaattctaaaccagagatgtgtctctcttgcccaggctgaagggcaatggtgagatcttagctcagtgaagcctcaacatattcggctcaagtaatcctcccacctcagcctcccaagtagttaggactatagttgtgggtaaccatgcccagctattttttttggtatctttttaaatttaattttattatactttaagttttagggtacatgtgcacaatgtgcagattagttacatatgtatacatgtgccatgttggtgtgctgcacccattaactcgtcatttagcattaggtatatctcctaatgctatccctccccccttcccccaccccacaacaggccccagtgtgtgatgttccccttcctgtgtccatgtgctctcattgttcaattcccccctatgagtgagaacacacagtgtttgctttttctccttgcgatagttggctgagaatgatggtttccagtttcatctatgtccctacaaaggacatgaaatcttcattttttatgtctgcatagtattccatggtgtatatgtgccacatattcttaatccagtctatcattgttggacatttgggttgtttccaagtctttgctattgtgaatagtgccgcaataaatcatatgtgtgcatgtgtctttatagcagcatgatttataatcctttgggtatatgtccagtagtgggatggctggatcaaatggtatttctagttctagaaccctgaggaattgccacgccaacttccaaaatggttgaactagtttacagtcccaccaacagtgtaaaagtattcctatttctccacatcctctccagcacctgttgttttctgactttttaatgatcgccattctaactggtgtgagacggtatctcattgtggtttgatttgcatttctctgatgaccagtgatggtgagcattttttaatgtgttttttggctgtataaatgtcttcttttgagaagtatctgttcacatccttcgtccactttttgatggggttgtctgcttttttcttgtaaatttgttggtgttcattgtagattctggctattagccctttgtcagatgagtaggttgtaaaaattttctcccattttgtaggttgccttctcactctgatggtagtttcttttgctgtgctgaacctctttagtttaattggatcacatttgtcaattttgacttttgttgccattgcttttagtgttttagaaatgaagtccttgcccatgcctatgtcctgaatggtaatgcctaggttttcttctagggtttttatggttttaggtctaatctgtaagtctttaatccatcttgaattaatttttgtataaggtgtaaggaagggatccagtttcagctttctacatatggctagaccattttcccagcaccatttattaaatagggaatcctttccccattgcttgtttttgtcaggtttgtcaaagatcagatggttgtagatatgtggcattatttctgagggctctggtgtactccattgatctatatctctgttttctatcagtaccatgctgttttggttactgtagccttgtaggatagtttgaagtcaggtagcgtgatgcctccagctttgttcttttggcttaggattgacttggtgatgcgggctcttttttggctccatattaactttaaagtagttttttccaattctgtgaagaaagtcattggtagcttgatggggatggcattgaatctataaattaccttgaacagtatgtccattttcatgatactgattcttcctgcccatgagcatggaatgttcttccatttgtttgtatcctcttttatttcattgagcagtggtttgtagttgtccttgaagaggtccttcacatcccttgtaagttggattcctaggtattttattctctttgaagcaattgtgaatgggagttcactcgtgatttggctctctgtttgtctgttattgatgcataagaatgcttgtgatttttgtacattgattttgtatcctgagactttgctgaaattgcttatcagcttaaggagattttgggctgagacagtggggttttctagatatataatcatgtcatctgcaaacaaggacaatttgacttcctcttttcataactgaataccctttatttccttctcctgcctaatagccctggccagaacttccaacactatgttgaataggagtggtgagagagggcatccctgtcttgtgccagttttcaaagggaatgcttccagtttttgcccattcagtgtgatattggcagtgggtttgtaatagatagctcttattattttgaaatatgtcccatcgatacctaatttattgagagtttttagcatgaaacgttgttgaattttgtcaaaggccttttctgcatctattgagataatcatgtatttttttgtcataggttctgtttatatgctggattatgtttattgatttgcatatgttgaacgagcttacatcccagggatgaagcccacttgatcatggtggataagctttttgatgtgctgctggattcgttttgccagtattttattgaggatttttgcatcaatgttcgtcaaggatattggtctaaaattctcttttttgttgtgtctgccaggctttggtatcaggatgatgctggcctcataaaatgagttagggaggattccctctttttctattgattggaatagtttcagaaggaatgataccagctcctccttgtacctctggtaaaattcggctgtgatttcatctggtcctggacattttgtttggtaagcttttgattattgcctcaatttcagagcctgttatttgtctattcagagattcaacttcttcctggtttagtcttgggaggttgtacgtgtcgaggaatttatccatttcttctaggttttctagtttatttgcatagaggtgtttataatattctctgatggtagtttgtatttctgtgggatcggtggtgatatcccctttctctttttttattgtgtctatttgattcttctctcttttcttctttattagtcttgctagcggtctatctttttttttttttatcctttcaaaaaaccagcttctggattcattaattttttgaagggttttttgtgtctctgtttccttcagttctgctctaattttagttatttcttgccttctgccagcttttgaatgtgtttgctcttgcttctctagttcttttaattgtgatgctagtgtgtcaattttagatctttcctgctttctcttgtgggcatttagtgctataaatttccctctacacactgctttgactgtgtccctgagattctggtatgttgtgtcttttttctcgttggtttcaaagcacatctttatttctgccttcatttcgttgtgtacccagtagtcattcaggagcaggttgttcagtttccttgtagttgagtggttttgagtgagtttcttaatcctgagttccagtttgattgtactgtggtctgagagacagtttgttataatttctgttcttttacatttgctgaggagagctttacttcgaactatgtggtcaattttggaataagtgtggtgtggtgctgaagaaaatgtatattctgttgatttgggttggagagttctgtagatttctattaggtctgcttggtgcagagctgagttcaattcctggatatccttgttaactttctgtctttttgatctatgtaatgttgacagtggggtgttaaagtctcccattattattgtgtgggagtctaagtctctttgtaggtcactaaggatgcgctttatgaatcttggtgcccctgtattgagtgcatgtacatttaggatagttagctcttcttgttgaattgatccctttaccattatgtaattgccttctttttttcttttgacatttgttggtttaaagtctgttttatctgagactaggattgcaaaccctgccattttttgttttccattggcttggtagatcttcctccatcctttcattttgagcctgtgtgtgtctcagtgtgtgagatgggtttcctgaatacagtacactaataggtcttgactttttatccaatttgccagtctgtgtcttttaattggagcgcttagcccatttacattcaaagttaatatttttatgtgtgtatttggtcctgtcattatgatgttagctggttattttgctcgttatttaatgcagttttcttcctagccttgatggtctttacattttggcatgttttcacagtggctggtaccggttgttcctttccatgtttagtgttccttcaggatttcttttagggcaggcctggtggtgacaaactctctcagcgtttgcttgtctgtaaagtattttatttctctttcacttatgaagcttagtttggctggctatgaaattctaggttgaaaattcttttctttaagaatgttgaatattgtcccccactgtcttctggcttgtggagtttctgccaagacatctgctgttagtgtgatggtcttccttttgtggctaacccgaactttctctctgactgcccttacctttttttgcttcatttcaactttggtgaatttgacaattatgtgtcttggtgttgtatttcttggggagtatctttgaggcgttttctatatttcctgaatctgaatgaagttctcctggataataacctgcagagtgttttccaaattggttccattctccccgtcactttcaggtacaccaatcagacgtagatttggccttttcacatagtctcatatttcttggaggctttgttcatttctttttattcttttttctctaaacttctcttctcacttcatttcattcatttcgtgttccatcactgataccctttcttccagttgattgcatcagctcctgaggcttctgcattcttcaagtagttcttgagccttggctttcagctccatcagctcctttaaggacttctctgcattgggtgttctagttatccattcgcccaattgtttttcaaagtttttaacttctttgacatcggtttgaatttcctcctgtagctcagagtagttcgatcatctgaagccttcttctctcagcttgtaaaagtccagctttgttctgttgctggtgaggagttgcgttcctttggaggaggggaagcactctgctttttagagtttccagtttttctgctgttttttccccatctttgtggttttatctacttttggtctttgatgatggtgacgtacagaagggttttcagtgtggatgccctttctgtttgttagttttccttctaacaaacagggtcctcagctgcatgtctgttggagttggctagtggtccactccagacactgttttcctgggtatcagcagtggtgcctgcagaagagcagtggctgtggaacagcagtggctgtagaacagcagtggctgtggaacagcaggtctttgtgaaccacatatgctgctgcctgaccttttgtctggaagttttgtctcagaggagtacccggctgggtgaggtgtcagtctgcccctactggggagtgcctcccagttaagcagttcgtggtgaaggacctacttgaggaggcagtctgtccattctcagatctctagccgcatgctaagagaatcactaatctcttcaaatctgtcagacagggacctttaagtctgcagaggttactacagtctttttgattgtctgtgccctgccccagaggtggagcctacacaggcaggcaggcttcctcgatctttggtgggctccacccagttcgagcttcccagctgctttgtttgtctatcaagcacgggcagttgcaggcacccctcccccagccttgctgccaccttgcagtttgatctcagagtgctgtgctagaaatcagggagattccgtgggcctaggactctctgagccaggtgcaggatataatcttctggtgtgctgctttttatgcttgatggaaaagcacagtattagagtgggagtgacccaattttcctggtgtcatctgtcacccatttctttgactaggaaagggaactccctgaccccttgcacttcctgagtgagacaatgcctcaccctgctttgtctcatctcatgcacggtgcactgcacccactgtcctgcacccatggactggcactccctagtgagatgaacctggtacctcagatggaaatgcatcactcacactgggagctgtagaccagagctgttcctatttggccatcttctgttttttgtagcttttatgtgaagataattcctttttcaaaataggcctcaaagggctcccaaatgtccctttgtggattctacaataagacagtttccaaactgctcaatcaaaagaaagtttcaactctgtgaggtgaatgcacagatcacaaagaagttcctcagaaagcttctgtctagtttttatgtgaagatatttccttttacaccataggactagaagggctctcaaatatctctttgcagattctacaaaaagaatgtttccaaactgctcaatgaaaagaaagtttcaactctgtcagatgaatgcacacatcacaaagaagtttctcagaaagtttctgcctagattttttatgaagatattgcctttttcatcataggtctcatacccctcagaaatattcctttgcagaacctacaaaaagacagtgtgcaaacttcacaatcaaaagacagtgtcaactctctgtgatgaatgcacacatcacaaagaagtttcccagaactcatcgttctagtttttaagtgaagatatttcctttttcaccttaagtctcaatgggctcccaaatatccctttacagatactacaaaaagactgtttccaaactgctcaatcaaaagaaaggctcaactctgtgagatgaaggcacacatcacgaagaagtttctcagaaagcttctgtctagtttttatgtgaagatagttcctttttcaccataggcctcaaaccactcagaaatatccctttgtagattctacaaaaagactgtatccaaactgctcaatcaaaagaaaggtcaaactctgtgaggtgaatgcacacatcacaaagaagtttctacgaaagttcctgtctagtttttatgtgaaggtatttcctttttcaccataggcctcaaagtgctcccaagtttccctttgcagattatgtgaaaagactgtttccaaactgctcaatcaaaagaaagtttcaactttacgagatgaattcacacatcacaaaagagcttctcagaaaatttctgtctagttttgatgtgaagataattcctttttcaaaatacgactcaaagggctgccaaatatccctttacagattctagaaaggactcaactctgtgagatgaatgcacacatcacaaagaagtttctcagaaagcttctgtctagtttttatgtgaagatagctcctttttcaccataggcctcaaaccactcagaaatatccctttgtagattctacaaaaagactgtatccaaactgctcaatcaaaagaaaagtcaaactctgtgaggtgaatgcacacatcacaaagaagtttctgtgaaagttcctgtctagtttttatgtgaaggtatttcctttttcaccataggcctcaaagggctcccaagtttccctttgcagattatgcaaaaagactgtttccaaactgctcaatcaaaagaaagtttcaactctgtgagatgaattcacacatcacaaagaccttctcagaaaatttctgtctagttttgatgtgaagataattcctttttcaaaataggcctcaaaaggctgccctaaagaaatatgcaactctgtgagatgaatgcacacatcacaaggaagtttctcagaaagtttgtgtctaatttttaggagaagatattccctttttctccataagactcaaaggcatccctaatatccctttgcagattccagaaaaagactgtttccaaaattatcaatcaaaagaaaagttcaactctgtgagttgaatgcacacatcagaaaaaaattcctcagaacgcttctgtctaggttttatgtgaagatatttcctttttcaccataagcctcaaaggactccaaatatccctttgcagattctacaaaaagactgtttgcaaactgttcaatcaaaagaaaggttcaactccgtgaaatgaaggcacacaacacaaagaagtttcccagaaatattctgtctagttcttatgtgaagatattccctattccctttttcaacatgggtctaaaatgtgatcccaagtatcccattgcagattctacaaaaagactgttaccaaactgttaaatcaaaacaaatgttcaactctgtgagatgaacgtacacatcacaaagaattttctcagaaagcttccatctagtttttatgtgaacatcatatttcctttttcaccttaggactcaaagggctccaaaatattccctttcagattctagaaaaagactattttcaaagtgctctatcaaagaaaaggttcaactcggtgagttgaatgcaaacatcacaaagaattttcacagaaagcttctgtctagtttttaatagaagttattttgttattcaccacaggcctcaaaccactaagaaatatccctttgcggattctagaaaaagaatgtttccaaactgctcaatcaaaagcatgctcaactttgtgaggtgaatgcacgcatcacaaagaactttctcagaaagtttctctctgttttctatgtgaagatatttcctttttcaccatgggcctcaaagggctcccaaatgtccctttacagattctacaaaaagacgctttccaagctgttcagtcaaaagaaaggctcaactttatgagatgaatgcacacataaaaaatcagcttctcagaacgcttctgtatagtttttttgtgaagattttccttcttcaacataggcctcaaaggcctcccaatatccctttgcggattctacaaaaagattgtttccaaactgctcaatgaaaagaaatgttcaactctgtgagatgaatgcacacatcacaaagaagtttctcagaaagcttctgcctagtttttaggtgaagatattcctttcttctccaatcaaaagaaaggttaagctctgtgcgattaatgtatacatcacaaaggagtttctgagaaagcttccatctaatttttatatgaagatatttcctttttcaccataggcctcaaagtgccctcaaatacccctttgcagattctacaaaaatactttttacaagctcctcaatcataagaaaatttgagctctgtgagatgaatgcgcacatcacaaagaagtttctcagaaatcttctgtttagttttaatttgaagatacctcatttttcaccataggcctcaaatcgctgagatatatcccatttcagattgtacaaaacgactgtttccaaactgctcaataaaaagaaaagttcaactctgtgatatgaatgcactcatcacaaagaagttactcagaaatcttccctctagttccatgagaagatatttcctttttcaccataggactcaaagggctcccaaatatccctttgcagatagtgaagatattttgtttttcacagtagcactcaagccactcagaaatatccccttgcagattctacaaaaagactctttccaaactgctcaatgaagagaatgtttcaactctgtgagatgaatgcacacatcacaaagaagttactgagaaagattctgtctagtttttatgtgaaaatatttcctttttcaccataggcctcaaaatgctcagaaatatgcctttgcagttttacaaaaagactgtttttttttgtaaaggaagttttttgagaaggaagtttctcaggaaccttctgtttaatatttatgtgaaggtatttcctttttcaccataggcctcaaagcaccctcaaatatccctttgcagatgttacaaaaagactgcttccaaactgctcaatcaaaggaaatgttcatctatgtgagatgaatgcacccatcacaaagaagtttctcagaaagcttctgtctagtctttctttatgtgaagatattttctttttcagcataggcctcaaagcacccacaagtatccctttgcagatgctacagaaagacggtttccaaactgctcaatcaaaagaaatgttcaactctgtgaggtgaatccacccatcacaaagaagtttatcagaaagcttctgtctagtttttatatgaaaatattacctttttcaccatgggcctcaatccgctaagaaatatccctttgcagattctataaaaagactgtttccaaactgctgaatcaaaagaaagttttaactctatgagatgaatgcccacatcacaaagaagcttctcagaaagattctgtctactttttatgtgaagataattattttttcatcataggcctaaatccgtacagaaatatccctttgcagattctgtaaaaagactgtttccaaattacccaatcaaaagaaaggttcaaactctctgagaataatgcacacatatcaaagaagtttctcagaaagattctgtccactttttaggtgaagaaatttcttttttcactgtttgagtgaaaccactcagaaatatctctttgcagatcctagaaaaagactgtttccacacagctgaatcaaaagaaaggttcaccactgtgaggtgaatgaactcatcatttctgagaaagaagtttctcagaaaccttctgtctagtttttatgtgtagatattccctttgtcaccataggcctcagagatctcccaaatatccctttgcagattctacacaaagactgtttcctaattactcaatgaaaagaaaggttcaactccgtgagacgaatgcacacatcacaaagaagtttctcagaaagcttctgtctagtttttatgtgaagatattccctttttctccaatcaaaagaatggctaacctttctgataaaagtgtttccaagctgctcaatcaaaagaaagtttgaactctgtgagatgaattcgctcatcacaaagaagtttctcagaaatctgtctagttttaatttgaaaatatttcctttttcactataggcctcaaatcactgagatatatctcttttcagattctgaaaaaagacggtttccaaactactcaatcaaaagaaaggtttaactctctgagatgaaagcacacatcacacagaagttcctcggaaggtttctgtctagttttatgagaaaatatttcctttttcaccataggactcgaagggctccaaatatcgctttgcagattgtgaagatattttgtttttcacagttgccctcaagccactcagaaatatccccttgcagtttctacaaaaaaaactctttccaaactgctctatcaaaaaaatgttatgactgtgtgtgatgaatgcacacatcacaaagaagttactgagaaagattctgactagtttttatgtgaagatattttctttttcaccacaggcctcaaagggctcacaaatatccctttgcagattctaccaaaagagtgtttccaaaatcctcaatgaaaggtaaggttcaattccgttagatggatgcacacatcacaaagaagtttctcagaacgtttctgtttactttttatgtgaagatatttcctttttgacaacaggactcaaactgctcagaaacattcctttgcagattctaccaaaaggctatttccaaactgatcaagaaaagaaagttcaactctgtgagatgaatgcacacatcacaaagtagtttctcagaaaggttctgtctagtttttatgtgaagatatttcctttttcatcatatacctcaaatctctcagaaatatccatttgctgtttgtaccaaaactctctttacaaactgctgaatcaaaagaatcattcaactctgtctgttgaatgcacacttcataaggaagtttatgagaaagcttctgtctagtttttatgtgaagatattttctttttcaccatagacctcaaagggcttgaaaatatcccttagcagttactacaaaaagaatgtttccaaactgttcaatcaaaaaaaacgttcaactctgtaagatgaatgcacacatcataaagaagtttctgaggaaacttctgtctagttttcatatgaagatatttcatttttcaccaaaggcctcaaactgctcagaaagatctctttgcagattctacaaaaacactgtttccaaactgctcaatcaaaagaaaggttcaactctgtgagatgaatacacacatcacaaagaagtttgtcagaaagcttctgtctagtttttatgtaaagatatttcctttttcaccatacaccttgaagggctcccaaatataccattgcagatgctacaaatactgtttcgaatctgctcaatcaaaagaaaggttcaattttgtgatatggatgcacacatcactgagaagtttctcagaaagcttctgtctgttttttatgtgaagatgtttcctttttcaccatagtcctcaaaccactcagaaatatttcctttgcagattctaccaaaagactttaaaaactgctcaatcaaaagaaagttcaactctgtaagatgactgcacgcatcacaaagaagtttctcagaaagtttctgtctagtgtttatgtgtagatatttccttttccaccacaagcctcaaactgctcagaaatatccctttgaagattctacaaaaagactttttccaaacttctcaaaaaaaaagacaggttcaactctgtgagatgaatgcacgcatcacagagacatttctcagaaagcttctgtctagtttttatatgaagatattccctttttcaccttaggcctcaaaaggatcccaaatatccgtttgcagattctacaaaaagactgtttccaaactgctcaatcaaaagaaaatttccgctctgtgagatgaatgcacacatcaaaaaaaagtttctcagaaaatttctgtctagcttttatgtgaagataattcctttttcaaaatatgcctcaaagggctctcaaatatccctttgcagattctacaaaagactttttccaaactgctcaagaaaaagaaaggttcaactctgtgagatgaatgcatacatcacaaagtcgtttctcagatagcttctgtctagtttttatgtgaagatattccctttttcacctttggccacaaagggatcccaaatatttatttgcagattctacaaaaagacagtctccaaactgctcaatcaaaagaaagtttcaactctgttaaatgaataaacccatcacaaagaagtttctcataaagcttctgtctagttttcatttgaagatatttcctttttctccattggcctcaaatcgctcagaaatatccctttgcagattctacaaaaaacggtttccaaactgctcaaccaaaagaatggtacagctctgggagatgaaagcacacatcacaaagaagttcctcaaaaaacttctctctagtttttatatgaagatatttcctttttcagcataggcctgacagcgcccacaaatatcactttgcagattctagaaaaagactgtttccaaagtgctcaatcaaaagatagtttcagctctgtgagatgaatccacacatcaataaaaagtttatcagaatatttctgtctagtttttatgtgaagataattcctttctcaaaatatgcatcgaagggctctgaaatatccctttgcagattctagaaaaaaaccgtttccaaactgctcaatcaaaagaaatgttcaactctgtgagatgaatgcacaggttacaaagatgtttctgagaaagcttctgtctagtttttatgtgatgatattttctttttcagcataggcctgaaagcacccacaaatatcactttgcagattctagaaaaagactgtttccaaactgctcaatcaaaagatagtttcagctctgtgagatgaatccacacatcaataaaaagtttatcagaaaatttctgtctagtttttatgtgaagataattcctttttcaaaatatgccttgaaaggctccaaaatatacctttgcagattctagaaaaaaactgtttccaaactgctcaatgaaaagaaattttcaactctgtgacatgaatgcacacatcacacagaagttcctgagaaagcttctgcctagtttttatgtgaagatatttcctttttcaccatagtcctcgaaggactcccaaatatccctttccggattcctcaaaaagaatgtttccaaactgctcaatcaaaggaaggttcaaatctgagagatgaatgcatatatcacaaagacgtttctcagaaaacttctgtctagtttttgtgatgatacttcctttttcaccaaaggcttcaaaatgattccaaatatccctttgcagattttataaaaagacagtttcaaaacttgtcaatcaaaagaaaggttcatctctgtgacatgaatgcacacatctcaaataagtttctcagagagcttctgtctagtttttgtgtgaagatatttcccttttcaccgtagtcctcgaagggctcccaaatatccctttgcagattctactaaaagaatctgtcaaaactgctcaatgaaaagaaaggtaaaactctgtcaggtgagtacacacatcacaaagaagtttcccaaaaagcttccctccagtttttacatgaagatatttactttttcatcttaggcctcaaaccactgagaaatatacctttgcagattcctcaaaaagaatgttacaaactgctcaatcaaaggaaggttcaaatcagagagatgaatgcacatatcacaaataagtttctcagaaatcttctgtcttttttttatgtgatgatatttgctttttcaccataggcctcaaacggattccaaatatccctttgcagattttataaaaagagtttcaaaactggtcaatccaaagaaacgttcaactctgtgacatgaatgaacacatcacaaagaagtttctcagagagattctgtctagttttatgtgaagatatttcccttttcattgtagtccttgaagggctcccaaatatccctttgcagattccacaaaaaagaatccgtccaaaatgctcaatgaaaagaaaggtacaactctgtcagatgaatacacacatcacaaagaagtttcccaaaaagcttccatctagtttttgcatgaagatatttcctttttcaccacaggcctcaaacctctgagaaatatccctttgcagattctacaaagagacagttaccaaaatgctcaatcaaaagaaagtttcaattctgttagatgaatgcacacgtcacaaataagtttctcagtaattttctgtctagtttttatgtgaagatattccctttctaaccataggcttcaagtggattcaaaatatcactgcagatctaaaaaaaagattgtttcaaaactgcacaatcaaaagaaaggttcaagtctgtgagatgaatgcacgcatctcaaatattttgtcagaaagattctgtctagttttcatgtgaacctatttcctttttcaccacaggccttaaagtgctcccaaatatcccattgcagattgtacaaaaagactgtttcctagcttctcaatcaaaagaaagtttcaactctgtgagatgaatacacacatcaaaaagaagtttcccagaaagcttctgtctagtttttatgtgaacatattttcttttttaccataggcctcaaagggctcccaaatatccctttgcagattctacaaaaagacattttccaaactgctcaatcaaaagaaagtgtcaattccatgaggcgaatgcaaaaatcacatagaagttccttagaaagattccatctagtttttatgtgaagatatttcccatttcaccataggtatcaaagggctcccaaatatccctctgcagattctactaataggctgtttccaaactgatcaatgaaaggaaaggttcaaatctgtgaggtgaatacacacaacacaaagaagtttctcagaaagcttctgcctactttttatgtgaagatatttcctttctcatcatatgcctcaaccctctcggaaatatccattcgctgattgtacaaaaagactctttccaaactgctcaatcaaaagaaatgttcaactctatttattgaatacacacatcagaaataagtttctgagaaagcttctgtctagtttttatgtgaggacatttcctttttcaacataggcctcagagggctacaaactatccctttgcagattcctcaaaaagaatgtttccaaagagctcaatcaaaggaaggttcaaatctgagagatgaatgcacatatcacaaataagtttctcagaaagcttctattttttatgtgatgatatttgctttttcaccgtaggcctcaaacggattccaaatatccctttgcagattttataaaaagacagtttcaaaactggtcaatcaaaagaaaggttcaactctgtgacatgaatgcacacaacacaaagaagattctcagagagcttctgtctagttattatgtgaagatattgctctttttaccatagtccttgaagggctcccaaatatccctttgcagattctacaaaaagaacctctccaaactgcacaatgaaaaaaaaggtaaaactctgtcaggtgaatacacacatcacaaagaagtttggcaaaatgcttccatccagtttttacacgaagatatttcctttttcaccataggcctcaaacctctgagaaatatacctttgcagattctacaaaaagacagtttccaaactgctcaatcaaaagaaaggctcaactctgttagatgaatgcacacatcgcaaagaagtttctcagtaattttctgtctagtttttacgtgaagatattccctttttcaccataggcctcaaatggattcaaaatatcactttgcagatctacaaaatactgtttcaaaactgctcaatcaaaagaaaggttcaactctgtgagatgaatgcacgcatctcaaatattttgtcagaaagattctgtctactttttatgtgaacatacttcctttttcaccacaggcctcaaatcactcccaaatatcccattgcagattctacaaaaggaccatttcctagcttctcaatcaaacgaaagtttcaactctgtgagatgaatacacacatcatgaagaagtttcccagaaagcttctgtctagtttttatgtgaacatattttctttttcaccataggtctcaaagggctcccaaatatccctttgcagattctacaaaaagactctttccaaactgctcaatcaaaagaaagtttcaactctgtgtgttgaatgcacacatcatgaagaagtttctgagaaagcttctgtgtagtttttatgtgaagatatttcctttttcaccacgggcctcaaagtgctcgcaaatatccctttgcagattctaaaaaaagagtgtgtccaaactgctcaatcaaaagaaagtttcaactctgtgagatgaatgcacacatcaccgagaagtttgtcagaaagctcctgtctagtttttatgtgaagatattccctttttcagcatggcctcaaagggattccaaatatcccttttcagattctacaaaaagactgtttccaaactgctcagtcaaaagaaaggttccactctgtgagatgaatgcacacatcacaaagtagtttctcagaaagcttctgtctagcttttgtgtgaacatatttcctttttcataacaggcctcaaagggctcccaaatatccctttgcagattctaccaaaagtctgtttccaaactgctcaatcaaaagaatatttcaactctgttagatgaatgcatgcatcacaaacaagtttctcagaaatcttcaatctagtttttatgtgaagatattccctttttcaacaaaggcctcaaactgctccaaaatatgccattgcacattctagaataagactgtttccaaactgctcaatcaaaagaaatgttcaacttttgagatgaatgcactcattacaaagaagtttctgagaaagaatctgtctagtttttatgtgaagatatttcctttttaaccataggcctgaaaccacttagaaatatccccttggagattctagaaaaatactgtttccaaactgctgaatcaaaagaaagtttcagctctgtaggatgaatgcacgcatcacaaagaagtttctcagaaagcttctgtctactttttgtgtgaggatatttccttttctaccataggcctcaataccctgagatatatccctttgcagattctagaaaaagacagttaccaaactgctcaatcaaatgaaagtttcaagtctgtgagatgaatacacaaatcacaaagaagtttcccagaaggcttctgtctatttttatgtgaagatatttcctgtttcatcataggcctcaaagtgacctcaaatgtccttttgcagattctacaaaaagactgtttccaaacttctcaataaaaaggaagtttcaattatgtgagatgaatgcacacgacacaaaggagtttctcagaaaatttctatttggtttttatgtgaagataattcctttttcaaaataggcctcaaagggctccgaaatatccccttgcagatttcacaaaaagactgcttccaaactgctcaatcaaaagaaaggttcaactcggtgtgatgaatgcacacagcactaaggagttcctcagaaatcttctgtctagtttttatgtgaaaatatttccttttttcaccatattcctcgaagggctcccaaatatccctttgcagattctacaaaaagactctttccatactgcaaaattgaaactaagtttcaactctgagagacagatgcacacatcacaaagaagctttccagaaagtttctgtctagtttttatgtgaagatatttcctttttcaccatatgcctcactgcaccctcaaatatcactttgcagatgctacaaaaggactatttccagctgctcaatcaaaagaaattttcaactctgtgagatgaatgcactcatcacaaagaagtttctcagaaagcttctgtctagttttcatgtgaagatatttccttttttaccataagcctcaaagggatcccatatatcatgttgcaggttgtacaaaaagactgtttctgaactgttcaatcaaaggaaagttttaggactgtgagatgaatgcacaattacaaacaagttcctctgaaatgtactatctactttttctgtgaaggtaattcctttttcaaaataggcctcagagggctcccaaatatccctttgcagattctagaaaaaggatgtttcctaactgctcaattaaaagacaattgcaactctgttagatgaatgcaagcataacaaacaagtttctcagaaatctttggtcttctttttatgtgaagatattctcttttcaccaaaggccttgaactgctctgaaatgttcctttgcacattctagactaagaccgtttccaaactgctcaatcaaaacaaagtttcaactctgtgaggtgaatgcacacatcacaaagaaatttctcagaaagtttctgtctagtttttttgtgaagatatttcatttttcaccataagccataaatggctgaaaagtatccctttggggattctataaaaagactgtttccaaactgctcaatcaaaagaaagattcaagtttgtgagatgaatggacacaacagaagaagtttctcagaatgcatctgtatagtttttatgtgaagatatttcctatttcagcataggcctcaaatcactcagaaatatccctttgcagattctacaaaatgacgttctcaaattgctcaatcaaaagaaagtttcaactctgtgagattaatgcacacatcactcagaagttcctcagaaatattctgcctcgtttttatgttaatatgtttcctttttcacaataggccacaaactgctctgcgatatccctttgcagattatacaaaaagatggtttccaaactgcttaatcaaaagaaagtttcagctctgtcagatgtatgcacacattacaaagacgtttgtcagaatcattctgtctagtttttatgtggaaatatttcctttttcactgtaggccacaaatggctcaaaaatatcacttgtagattctacaaaaagactgtttacacactgcttagtcaaaagtaaatttgaactctttgagatgaatgcatgcatcacaaagacctttctcagaaagcttctgtctagttttaatgtgaatatattccccaccataggcctgaaaaagcactcaagggtcccattgcagattctacaaaatgagtatttccaaactactcaatcaaaagaatggttcaagtctgtgagatgaattcacacatcacaaagaagtttcacagaaagcttctgtctagtttttatgtgaagatatttcctttttcaccataagcctcaaaccgctcagaaatatccctttgcagattctataaaaagactgtttccaaactgctcaaacaaaagaaaggttcaactctttgagttgaatgcacacatcacaaaaagtttctcaaaaagctttcgtgtagtttttttatgaacatatttcctttttcacaataggcctcaaaaagctcagaaatatccctttacggattctacaagaagactgtttccaaactgcataatcaaaagaaaatttcaactgtgtgagacgaatgcacacatcacaaagaagtttctcaaaaagcttctgagtagtttttatgtgaacatatttcctttttcacaataggtctcaagccactcagaaatatccctttgtggattctacaaaagactgtttccaaactgctcaaacagaagaaagttttagctctctgaggtgaatgcatacataacaaagatgtttctcagaaaggttctgtctagtttttatgtgatgatatttccttatgcatcataggcctcaaaccaccttctagtatcccttttcagattctagaaaaggactgtatcaaaactgctctatcaaaacaaagtttcaactctgtaagttgaaagcccacagtgaaaagaagattatcaggaagattgtctagtttttatgtgaagatatatcctttttcaccataggcctcaaactactcagaaatatccctttgcagattctacaaaaagactgtttccaaattgctcaatcaaaagaatggttcaacactgtgagatgaattcacacatcacaaagaagtttctcagaaagtttctgtctagttttcatgtgaagatatttcctttttcaccatagtcctcaaagggatcccaaatattcctttgcagattctacaaaaagacggtttccaaactgctaaatcaaaagaaagctttcactctgtgagatgaatgcacacatcacaaagaagttcttcagaaagctgctttctagtttttatgtgaagatatttcctttttcaccatagacctcgaacggctcccaaatattcctttgcagattctataaaaagactgtttccaaactgctcaatcaaaataaagtttcaactctgtgagtttaattcacacatcacaaagaagtttctcagtaagcttctgtctagtttattttgaagatatttcctttttcacaatagaccacaaactgctcagaaatatccctttgcagattctacaaaatgatggtttccaaactgttcaatcaaaagacagcttcaaatctgtgagatgaatgcatgcatcacaaagaagtttttcagaatgcttctgtctagtttttaagtgaagatattcccttttttaacattggcctcaaagggatcctaaatatccatattcaaattctagaaaaagactgtttccaaactgctcaatcaaaagtaagtttcaactctgtgagatgaatgcacgcatcacaaagaagtttctcagaaagcttctctccagtttctatgtgaagatatttcctttttcaccataggcctcaatgcgccttcaaatatcactttgcagattctacaaaagactgtttccaaacggctcaatcaaaagaagctttcaactgtgtgagatgaatgcacacatcacaaaagggtatctcagaaaatttctgtctagtttttatgtgaagataattccattttcaaaatgggcctgaaaggtctccaaaatgtcccatttcacattctagaaaaagagtgttcccaaactgctccaccaatagaaaagttcaactttgtgaggcgaatgcagacatcacaaagaggtatctcagaaagcttctgtctagtttttatgtgaagatattcccttttttaacattggcctcatagggatccaaaatatccgttttcagattgtagaaaaagactgtttccaaactgctcaattgaaagaaagtttcaactctgagaaataaatgcacacatcacaaagaagtttctcagaaagcttctgtctagttttttgtgcagatatttcctttttcaccataggcctcaaactgctcagaaatatccctttgaagattctacaaaaagactctatccaaactgctctttcaaaagaaaggttcaactctgtgagatgaatgtgcacatcacaaaggaatttatcagaaagcttctgtctagtttttatgtgaagatatttcctttttcaccataggcatcaaatggctcccaaatatcactttgcagattctacaaaaatactgtttccaaaatgctcaaccaaaagaaaggttcaactctgtgcattgaatccatgcatcaaaaggaagtttctcagcaaacttctgtctagtttttatgtgaagatatttccttattcaccacaggcctcaaaatgctcagaaatatccccttgcagattctagaaaaagactatttccaaacttctcaatcaaaagaaaggttcaactctgtgatatgaatgcacacatcacaaagaagcttcttagaaagactctatctagtttcttgtgaagatatttcctttttcaccttaggtgtcaagtatttcagaaacatccctttgcagattctacaaacacactgtttccaaactgctcaatcaaaaataggttcaacactgtgatatgaatgcattcatcacagaagagtttctcagaaaaaatgtgtccaatttttatgtaaagaaaatttctttttcaaaataggcctctaaagtttcccaaatatccctttgccgattctaaaaaaagactgcttcaaaactgctcaattgaaagaaaggtttaactctgtgagatgaatgcacacatcacaaaatgtttctgagaaagcttctgactagtgtttctgtgaggatatttcctttttctccatgggcctcaaagggttcccacatatccatttgtagattctgcaaaaagaatttttccagactgctcaatcaaaagaaaatttcaactctgtgagatgtatacatgcatcacaaagaagtttctcagaaagcttctgtctagtttttatgtgaagatattttctttctcaaaattggcaccaaaaggccctcaaatatccctttgcagatactacaaaaaaactgtttccaaactgctcaatcaaataaagtttcaactctgtgagttgaatgaacacaaaacaaacaagtttctcagaaagcttctgtctagtttttttgtgaagatatttcctttttcaccataggccttacaccgcagagaaatatccctttgcagatcctacaaaaacactgtttcaaaactgcacaatcaaaagaaagtttcagctctctgagatgaatgcacacatcacaaagaaaaaaattctcggaaaacttctgtgtagcttttatgtgaatatatttcctttttcaccataggcctcaaagccccctcaaatatcccatgtagattctatgaaaaaactgtgtccaagctgctcaatcaaaagaaagtttcaactctgtgagaggaaagcacacatcttcaaatgtgtgagatgaatgcacacatcacacagaagttcctcagaaagcttctgtctagtttttatgtgagggtatttcctttttaaccataggcctcaagctgctcagaaatatccctttgcagattctacaaaaaggcagtttccaaactgctcaatcaaagggacatttgaggacacttctctgaaagcctctgtctagttattatgtaaagatattcactttttcaccattggcctcaaaagactaccaatatccctttgcagattctacaaaaggactgtttccaaactgctcaatcaaaagaaaggttcaactgtgtgagatgaatgcacacatcacaaagaagtatttcagaaggcttctgtctcaggttttttgaagatattccatttttcaccatagtcctcaaagggataaaatatatccctttgcagattctacaaaaagagttttttttttttcaccataggctttccgagaaacttcattgtaatgagtgcattcatctcgcagagtggaacgtttcttttgattgagcagtttggaaacactctttttgtagtatctgcaaatggatattgggagcgctttgaggcctatagctgaaaaggaaatatcttcacataaaaactagacagaagcattccaagaaacttctttgagatgtgtgcattcatctcacagagttgaaaatttcttttgactgagcagtttggatacagtctttttgtaatatctgcaaagggataatttgaagacctttgagttatatggtggaaaagaaaatatcttccataaaaactagacagaaggatcctgaaaatcttctttgtgatgagtgcattcatctcagagttgaaactttcttttggttgaacagtttggaaacagtctttttgtagaatctgtaaagggatatttgggatccctttgaggactatggtgaaaaagggaatatcttcaaaaaagactagacataagctttctgaaagacttctttgtgatgtgtgcattcatctcacggagttggacctttcttttgattgagcagtttggaaacagtcttttaatagaatcggcaaagggatatttggagccctttgaagagctgaaaaaggaaatatcttcatataaaaactaggtagaagctttctgagaaacataattgtgacgtgtgaattcatctcacagagttgaacctttcttttgattgagcagtttggaaacagtcttttaagagaattttcaaagtgatatttctcagtgatttgaggcctaaggtgaaaaaaagaatatatctttacataaaaactagagagaagttttctgattaacttatttctgatatgtgcattcatctcatattgttgaacattacttttgattgagcagattggaaacagtctttttgcagagtctgcaaagggataattgggatccctttgaggactatgatgaaaaaaaatatcttcacataaaaactagacagaatcattctgagaaacttctttgtgatgtgtgcattcatctcacatagttgaacctttcttttgattgagcagtttagaaacagtctttttgtaaaatctgtcaagggatatttgtctccagtttgaggcctatggtgaaaaaggaaatatcttcacataaaaactagaaagaagctttctgagaaacttctttgtgatgggtggattcatcaaacagagtagaacctttcttttgattgagcagtttggaaaaagtctttttgtagaatctgcaaagggatatttgtggacactttgaggcctacgttgaaaaagtaaccttttcacatgaaaactagagagaagatttctgagaaacttctttgtgatgtgagcattcatctcacagagttgaaactttcctttggttgagcaatttgtaaacagtcttttgtagaatctgtaaagggatatttgggacccctttgaggtctaatgtgaaaaaggaaatatcttcaaatagaaactagacagaagttttctgagaaacttatttgtgatgtgtgcattcacctcaaagagtttaacctttcttttgattgagcagtttggaatcagtctttttctagaatctgcaaagggatatttttgagggatttgaggactacagtgaataaggaaatatcttctaagaaaaactacacagaagctttcagggaaaattgtttgtgatgtgtgcattcaactcaaggaattaaaatttttatttgattgagcagttaggaaacagtcttttggtagaacatgcaaattgatatttgggagtcctttgagggcctatggtgaaaaaggaaatatgttcacataaatactagacacaagctttcagagaagcttctttttgatgtgtgcattcaactcacagagttgaaccttactttcgattgagcagttttgaaagtctttttgtagaatctgcaaagggatatttgggatacctttgaggaccatggtgaaaaagggaatatcttcacaaaaaaactagacagaagctttctgggaaacgtctttgtgacgtgtctattcatctcactgagttgaacctttcttttgtttgagcagttgggaaacagtcttcttgtaaattctgcaaagggatatttggagccctttgaggcctacggtgaaaaagcaaatatcttcacgtaaaaactagtcagaagctttctgagaaacttctttgtgatgtgtaaattcatctgccagagttgaacctttattttgattgagcagtttggaaacagttttcttgtaggatttgcaaaaggatatttgggagccctttgaagctcatggtgaaaaaggaaatatgttcacataaaaattgtacagaagttttctgagaaacttctttgtgatgcgtgtattcatctgacagagttcaacctttgttttgattgagtagtttggaatcagtctttttgtagaatctgcaaagggatatttgggatccatttgaggcccatggtaaaaaagggaatatcttcacgtaaaaactagacagattctttctgagaaacttatttgtgatgtgtgtgttcatctcacagagttgaagctttcttttgattgagcagtttggaaacagtctttttgtagaatctgcaaaaggatatttctgagtggtttgaggccagtggtgaaaaggtaaatatcttcacataaaaactagaccgaatatttctgagaaaagtctttgtgatgtgtgcattcatctcacagaatagaaactttcttttgattgagcagcttggacacagtctttttgtagaatctgcaaaaggatgtttgtgggtactttgaggcctatagtaaaaaagggaatattttcatataaaaactagacagaaattttctgagaaacttatttgtgatgtgtgcattcatttcccagagttcaaattttcttttgattgagcagtttggaaacagtctttttgtagaatctgcaaagggatgtttctgagcggattgaggcctacggtgaagaaggaaatatcttcacataaaaactaggcataagctttctgagaaactattttgtgatgcgtgctttcatctcccaaagatgaaccattcttttgattgagtagtttggaaacattatttttccagaatctgcaaagggatatttggaagctctttgaggcctattttgaaaaaggaattatcttcacataaaaactagacagaaattttctgagacacacttttttgatgtgtgcattcatctcacaggtttgtacctttcttttgactgaacagtttggaatcagtctttttctagaatcagcctaaggatatttgtgaggccttcgaggcctatggtgtaaaaggaaatatcttcacataaaaactagatagaagctttctgaaaaacttatttgtgctgcgagcattcatctcacagagttgaaactttcttttgattgagcagtttggaaacggtctttttgtataatctgcaaagggatatttgggatccctttgaggtccatggtgaaaaagggaatatcttgaaataaaaactggacagaagctttctgaaaaacttctttgtgatatctgcattcatctcccacagttgaatatttgttttgattgatccgtttggaaacagtctttttgtagaatccgcactagggtatttttgagtgttttgaggcctgttatggaaaaggaaatatctttatatgaaaactagacagaagttttctgagaaacttttttgtgacgtgtgcatttatctcacagagatgaacatacgtttttattgagcagtttgcaaacagtcttttgatactatctgcaaagggatatttctgaacggttagaggcctatggtgaaaaaggaaatatcttcatgtaaaaactagacagaagctttcggagaaacttctttatgatgtgtgcattcacctgacagagttgaaactttcttttgattgaacagtttggaaatagtcttttttcagaatctgcaagggacatttgggagccccttgaggcctatggtgaaaagggaaatatcttcacataaaaactagaaagaaggtttctgagaaacttctttgtgatgtgtgcattcaactcacagagttgaaaattatttttgagtgaatattttggaaacagtcattttgtagcatctgcaaagggatatttgggagacccttgaagcctatggagataaaggaaatatcttcacataaaatctagacagaagctttctcagaaacttcttcatgatatgtgcattcatctcacagagttgaaactttcttttgattgagaagtttgaaaacagtctgtttgtagaatctgccaagggttatttttgaacagcttgaggcctatggtgaaaaagaaaatatcttcacataaaaactagacagaagttttctgagaaactacttttgatgtgtgcattcctctcaccgagttgaacctttcttttgattgatcggtttggaaacattctttttgtacaatccacactgggctatttctgagtggtttgaggcctatgatgaaaaaggaaatatcttcatgtaaaaactagacagatgttttctgagaaactactttgtgatctgtgcatttctctcacagagctgaacatatcctttgattgagtagtttggaaacagtattttttgtagaatctgcaaagatatatttgggatacgttcatggccaaaggtgaaaaatgaaatatcttcacataaaaactagacagaagctttctgggaaactttttgtgatgcgtgcattcatcacagagttgaaactttcttttgattgagcagtttggaaacagtctttttctagaatcttcaaagggatatttctgagctgttagaggcctatggtgaataggtagatgatttctgggaaacttttgtgatatgtgcaaagactgtttccaagctgctcaatcaaaagaaaggttcaactctgtgagatgaatacacacataacaaaaaaggccttcagaaagcttctgtttatattttatgtgaagatatttccttttttatcttagtcctcaaaacactcagaaatatcactttgaagatatgacaaaaagacgttttccaaactgcatgatcaaaaaaagtttcaaatctgtgagatgaatacacacatcacaaagaagtttctgagaaagcttctgactagtttttatgtgaagatattttctttttcaccaaagacctcaaaaagctcacaaatatccctttgcagattctaaaaaaagacagttttcaaactgctcaaataagaaagtttcaactctgtgagataaatgcatgcatcacaaagaagtttctcagaaagcttctttctagtttttatgggaagttatttcctttttcactgtaggcctcaaagcgccctgaaatatcactttgcagatgctacaaaagactgtttccaaactgttgaatcaaaaggaaggttcaaatctacgagatgaatgcacacataacaaaagtgtatctcagaaaatttctgcctagttttaatgtgaagataattcctttttcaaagtaggcctcaaagggctccgaaatatccttttgcagattctacaaaaagactatttccaaactgtgcaatcaaaagtaagttacaactctgagtgaattcacacatctgaaagcagtttttcagaaagcttctgtctagtttttatgtgaagatatttccttttccaccatgggcctcaaaatgccctaaaatatcactttgcagattctacaaaaagaacgtttccaagcggctcaatcaaaagataggttcaacttggtgagatgaatgcacacatcacaaagaagtttctcagaatgcttctgtctagttattatatgaagatatttcctttttcaccttaggccacaagccactcagaaatatccttttgcagattctgcaaaaagattccttcaaaactgctcaaaagaaagtttcaatgctttgagatacatgcacgcacagaaagatgtttctgagaaagcttctgtctggtttttatatgtagttattccctttttcaccatgggcctcaaagggatccaaaatatccctttgcagattctaaaaagactgtttccaaactgctcaaccaaaggaaagtttcaactctgtgagatgaatgcacacatcaaaaagaagtttctcagaaagattctgtctagtttttttttttttattttttttattttttattatactctaagtattagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggataggaactcatcattttttatggctgcatagtattccatggtgtatgtgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaattagtttacagtcccaccaacagtgtaaaagtgttcctatttctccacatcctctccagcacctgttgtttcctgactttttaatgattgccattcaagatggattaaagatttaaacgttagacctaaaaccataaaaaccctagaagaaaacctagacattaccattcaggacataggcgtgggcaaggacttcatgtccaaaacaccaaaagcaatgacaacaaaagccaaaattgacaaatgggatctaattaaactaaagagcttctgcacagcaaaagaaactaccatcagagtgaacaggcaacctacaacatgggagaaaattttcgcaacctactgatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagcaatgcaaatcaaaaccactatgagatatcatctgtctagtttttatgtaaatatatttcctttttcaccatagtcattaaagggattccaaatatctctttgcaggttctacaaaaagactgttatcaaactgctcaaacaaaaggaaagttcaactctgtgagatgaatgcacatatcacaaaaaagttcctcagaaatcttctgtctagtttttatatcaagatatttcctttttttctccttaggcctcaaaccgctcaaaaatatcacattaaagattctcctaaaagactgtttccaaacttctcaatcaagacaaaggttcagctctgtgagatgaatgcacacatcataaagaagtttctcagaaagcttctgtctagtttttatgaatatatttcctttttcaccataggcctcgaagggcccccaaatatccctttgcagattctacaaaaagactgtttcaaaactgctcaatcaaaggaaagattcaactctgtcacatgaatgcacacatcataaataagtttctcagaaagcttctatctagtttttataagaagatatttcctttttcaccatagtactcaaagcgctgagaaatatccctttgcagattctataaaaagactgtttccaaactgctcaatcaaaaggaagtttcaactctgtgagaggaatgcacgcatcacaaagaagtttctcaaaaatcttctgtctaatttttatgtgaagatattccctttttcactgtgggccttaaaggaatctgaaatatccctttgccgattctacaaaaagagtgttgtttccaaactgctgaatcaaagaaagattcaactctttgagatgaatgcacacaacacaaagaagtttctgagaaagtttctgtctagttttatgtgagtatatttcctttttcatgataggcctcaaagggatccctaatatccctttgcagattttacaaaaagatcaaaactgctcaatcaaaagaaagtttcacctctatgagatgaatgcacacatcacaaaaagtttctgagaaagtttctgtctagtttttatgtgaatatgcttcctatttcaccataagcctcaaagggatcccaaatatcccttagcagattttacaaaaagaatgttaccaaactgttcaatcgaaagaaaattacaactctgtgagataaatgcacacgtcacacagaggttcctcataaaccttctgtgtagttatctgaagatatttcccttttcacattttaccacaaagggctcccaaatatccctttgcagattttacaaaaagaatgttaccaaactgttcaatcaaaagaaaattacaactctgtgagataaatgcacacatcacacagaggttcctcataaaccttctgtgtagttatctgaagatatttcccttttcacattttaccacaaagggctcccaaatatccctttgaagattctacaaaaagactgtttcctaactgctcaatcaaaagaaagtttcaactctgtgagatgaatgcaggcatgacaaagaagtttctcagaaagcttctgtctagtttttatgtgaagatatttccttttacaccaatggcctcaaagggataccaagtatccctttgcagattctacgaaaaggctgcttccaaactgctcaatgaaaagaaagtttcaactcagtgagatgaatacacccatcacaaagaagtttctcagaaagcttctctctattttttatgtgaaatatttcctttttcaccataggccacaagcctttcagaagtattcctttgcagattctagaaaaagactgtatccaaactgtttaatcaaaagaaatgttcaactctgtcagatgaatgcacacatcacaaagaagtttctcagaatgcttctatgtagttcttatgtgaagatattttcttttcaccataggcctcaaggagctctcaaatacccctttgcagcttatacaaaaagacattttcaaactgctcaatcaaaacaaaggttcatttctgtgaaatgaatgcacacaacacaaagaagtttctgaaaaatcttctttctagatttatgtgaagatatttcctttttcaccgtaggcttcaaagcactccaaatatccatttgcagattctacaataagactgtttccaaactactcaatcaaaagaaagattcaggaagggattcagtttccgctttctacatatggctagccagttttcccagcaccatttattaaatagggaatcctttccccattgcttgtttttctcaggtttgtcaaagatcagattgtagataggcggtgttatttctgagggctctgttctgttccattgatctatatctctgttttggtaccagtaccatgctgttctggttactggttactatagcaaagacttggaaccaacccaaatgtccaacaatggtagactggattaagaaaatgtggcacatatacaccatggaatactatgcagccataaaaaatgatgagttcatgtcctttgtagggacatggatgaaattggaaatcatcattctcagtaaactatcgcaagaacaaaaagtcaaacactgcatattctcactcatagttgggaattgaacaatgagatcacatggacacaggaaggggaacatcacactctggggactgttgtggggttgggggaggggggagggatagcattgggagatatacctaatgctagaggacaagttagtgggtgcagtgcaccagtgtggcacatgtatacatatgtaactaacctgcacaatgtgcacatgtatcctaaaacttaaagtataataataaaagaaaaaaaaagaaagattcaactctgtgaaatgaatgcacacatcacaatgaattttctcacaaagcttctatctagttcttatgtgaagatattccctattccctttttcaacatgggcttaaaaatgatctcaaatatccctttgcagattctacaaaaagaccgtttccaaactgctccatcaagacaaatgttgaactctgtgagatgaatacatgtatcacaaaaaattttctcagaatgcttccatctactttttatgtgaatatatttcctttttcaacttagacctcaaagggctcccaaatatccccttgtggattgaagaaaaagactatttccaaactgctcaatcaaaataaatgttcaaatcggtgagttgaatgcaaacatcacaaagaattttcacaaaaaccttctgtctaatttttaatagaagttatttccttattcacctcaggcctcaaaccactcagaaatatccctttgcagattatagaaaaagacagtttccaaactgttcaatcaaaagaaatgttcaactctgtgagttgaatgaacacatcacaaataagtttgtcagaaagcttctctattttttgtgtgaagatatttcctttttcacggtaggcctcaaagggttcccaaatgtccctttgcagattctacaaaaaaactgtttccaagctgttcagtcaaaagaaagtttcaacattgtgagatgaatccacacataacaattaagtttctcagaaagcttctgaatagttttgttgtgaagatatttcctttttcaatgtggacttcaaaggactccaaaaatccctttgcagattctacaggaagactgtttccaaactactcaatgaaaagaaaggttccactgtgtgagatgaatgtacatatcacaaagaagttcctcagcaagcttctttctagtttttatgtgaaggtattccctttttctccaatcaaaagaatggctaacttctgtgagatgaataaacgcatcacaaaggagtttctcagaaagcttctgtctggtttttatctgaagatatttcctttttcaccataggcctcaaagcacccacaaatatccctttgcagattcgtcaaaaagactgtttccaagctgctcaatcaaaagaaggtttgaactctgtgagattaatgtacacatcacaaagaagtttctcagaaatcttttgtctagttttaatttgaagatatttactttttcaccataggcctcaaatcactgacatatatcccttttcggattctacaaaaagacgacttccaaactgctcaatcaaaagaaaggttcaactctgtgagatgactatgtacatcataaataagttcctcagaaaccttctgcctagtttttagctgaagatatttcctttttcaccgcaggcctcgaagggctcccaaatagacctttgcagattctacaaaaagactgtttccaaaactctcaatgaaagataaggttcaatcccatgagttggatgcacacatcacaaagaagtttctcagaaagcttctgtctagtttttatgtgaagatacttcctttttcacaacaggcctcaaactgctcagaaatattcctttgcagattctacaaaaaaaatgtttccaaactgctcaatgataagaaagttcagctctgtgagatgaatgcacacatcacaaaaaagaagtttctcagaaggttctgtctactttttatgtgaagatatttcctttttcaccataggcctcaaagcgccctcaaatatccctttgcagattctacaaaaagaccatttacaaactactcaatcaaaagaaatgttgatctctgtaagatgaatgcacacatcacaaagaagtttctcataaagcttatttctggtctttatgtgaagatattttccttttcaccataggcctcaaagcaccctcaaatatccctttgcagattctacaaaaagaaggtctccaaactgctcaatcaaaagaaagtttcaactccgtgagatgaatgcaccatcaaaaagaagtttctccaaaagattctgtctagttttttttatgaaaatacttcctttttcaccataggcctcaatccgctcagaaatatccttttgcagattctataaaaagactgtttacacactgctcaatcaaaagaaattttaactctatgagatgaatccacagatcacaaagaagcttctcagaaagattctgcctactttttaagtgaagataaatcttttttcaccataggcctcaagcagctcagaaatatccctttgcagattctattaaaagactgtttccaaactgtccagtgaaatgaaaggttcaactctctgacaggaatacacacaactcaaagaagtttctcagaaggattctgtctagtttttaggtgaagatatttctgttttcaccaaaggcctcaaagtcatcccaaatatccctttgcagattctacaaaaagactctttccaaaatgttcaatcaagaggaagtttcaactcagtgagctgaatgcacacatcacaaagtagtccctcacaatgcttctattttttttatgtgaagatatttcctttttcaccataggcctagaaggtgtcacaaatatccttttgcagatactacaaaaagactgtttccaacctgctctttaaaaagaaagtttcaattctgtgagatgaatgcacacatcacaaagaagtttctgagaaagtttctgtctaatttttaagtgaagatgtttcctttttcaccataggcctcaaaatgctcataaatatacctttgcagattctagaaaaagactgtttacaaactgctcaatcaaaaaaagtttcaactctgtgaaatgaatgcacacatcacaaagaagtttctcagaaagcttctgtctagttctaatgtgaagatatttcctttttcaacatgcgcctcaaagcgatcccaaatatccctttgcagattccacaataagtctgtttccaaactgcttaatctaaagaaaggctcaactctgtgagatgaatgcacacatcaaaaagaagtttctcagaaagcttctgtctagtttttatgtgaacgtatttgctttttcaccttaggtgtaaaaaggtacccaaatatccctttgtggattctagaaaaagatgatttccaaacagctcaatcaaaagaaaagttatactctgtgagttgaatgcacccatcacaaagaagtttcaaagaaagcttcgttctagtttttatgtgaagatatttactttttcaccatgggcctcaaaccactcagaaatatctctttggaaattctacaaaaagactgtttccaaactgctcaatcaaaataaacgttcaactctttgagatgaatatacacatcatcaaagagtttctcatgaagcatctgtctagttgttatgcgaagacatttcctttgtcacagtagacctcaaaacaccctcaaatgtccttttgcagatcctaggaaatgactgtttccaaactgctcaatcaaaagaaaagttaaactctgtgagatgaatgtgcacatcaaaaagaagttgctcagaaaagttctgtctggtttatatgcgaagatatatcctttttcaccacaggcctcgaagggttctcaaatatccctttgcggattcttcaaaaacactgtttctaaatttctcaatcaaaggaattttcagttctgtgagatggatgcacacatcacaaagaagtttctcagaaatcttctgtctagtttttatgtgaagataattactttttcaccataggcctcaaatcactgagaaatatcccattgcagattcttgaaaaagactgtttccaaactgctgagtcaaaagaaatgttcagctctgtgagatgaatgcacacatgatgaagaaatttctcagaaagcttctatctagattttatgtgaaggtatttcttttttcaccataggcctcaaacccctgagaaatatccctttgcagattctagaaaaagactgttttcaaattcatcaatcaaaagaaagattcaactctgtgtgatgaatgcacacatcaccaagaagcttctcagaaagcttctgtctagtttttatatgaagatatttcctttatcaccataggcctcaaagcaccctcaaatatcccttttcagattctacaaaaagactgttttcaaactgctcaatcaaataaatatttatctctgtgagttgaatgcacaaatcgcaaagaagtttctcagaaaacttctctctagtctttatgtgaagatatttcctttttcaccataggcctcaaagcaccctcgaatatccctttgcagattcttcaaaaagactgtttccaaactgctcattcaaaagaaagtttcaactctgtgagatgaatgtgcacatcactaagaagtttctcagaaatgttctgtccaatttttatatgaggatatttcctttttcaccatatgcctcaaaccactcagaaatatccctttgcagatcctacaaaaagactgtttacacactgctcaattaaagaaagattcaactccgtgaaatgaatgaacacatcacagagaagtttttgagaaagctcctctagttgtaatgtgaagatattccctttttaaacatgatcctcaaagggatcccaaatatccctttacagattctacaaaaggactgtttccacactgctctatctaaagaaagtttcaaatctgtgagataaatgcacgcatcaaaaagaagtttctcagaaatctgtctagtttttatgtgaacgtctttcctttttcaccttaggcctcaaagggccgccaaatatccctttgcgaatacttcaaagaggttattttcaaacttctcaaaaaaaagaagagttctactctgtgagtagaatgcacacatcacaaagaagtttcacagaaagctactgtctagtttttatatgaagatatttcctttttcaccataggcctcaaaccactcagaaatatccctttggagagtctacaaaaagaatgtttccaaaatgtccaatcaaaagaaaggttcatccctgtaatatgaatgcacacatcacaaaaaagtttctcagaaagcttctgtctagtttttatgtgaagatatttcctttttcaccgtaggcctcaaaacgccctcaaatgtccccttgcagattctgcaaaaagactgttttgaaacttctcaatcaaagtaaaggttcaactctgtgcatgaatgtacacatcacaatgaagtttctcagaaaatttctgcctagttttatgtgaagatatttcctttttcaccacaggcctcaaccgctcagaaatatccctttgcagattctacaaaaggagtgtttccaaactgctcaaccaaaagacagtttcaactctgtgagatgaatgcacacatcacaaaaaagtttctcagaaagcttctttctagtttttatgtgaagacatttcctttttcaccataggcctcaatgaactcccaaatatcactttgcagatttttcaaaaagactgtttccaaattgctcaatcaaaagaaaggttcaactctgtgagatgcatgtgcacatcaaaatgaagttgctcagaaaacttctgcctagtttttatgtgaagatattccctttttcaccataggactcgaagggctcccaagtatccctttgcagattatttaaaaagactgtttccatattgctctatcaaaagatagtttcacttctatgagatggatgcacacatcacaaagaagtttctcagaaaacttctgtctagtttttatgtgtagataattcctttttcaccataggactcaaaacactgagaaatatccctttgcagatccttgaaaaagactgtttccaaacttcccaatcaaaaaaaaggtttaatgctgtgagatgaatgtacacatcctaaagaagtttctcataaaacttctgtctagtttttatgtgaagatatttcctttttcaccataggcctcaaagggatccaaaatatccctttgcagattttacaaaaagactttttccaaactgctcaatcaaaagtaatgctcaaccctgtgagatgaatgcacacatctcaaagaagttcctaaaaaagcttctgtctagtttttatgtgaacatatttcctttttcaccttaggacttgaaatgctcccaaatatccctttgcagattctacaaaaagactgtttccaaactgttctaatcaaaagaatggttcaattctgtgagagggatgcagacatcacaaagaagtttatcagaaagcttctgtttagtttttatgtgaagatatttcctttttcatcgtaggcctcaaggcactcagaagcattcctttgcagattctgcgaaaagactgtttccaaactgctccaagaaagttcaacactgtgagatgaatgcatgcatcacaaagaagtttctcagaaagattctgtctattttttatgtgtagatatttcatttttcaccataggcctcaaaatgctcccaaatatccctttgcagattctacaaaaagagtgtttccaaactgctcaatcaaaagataattttatcaagctcccaatgactttctccacagaattggaaaaaactacttttatgttcataaggaaccaaaaaagagcctgcattgccacgtcaatcctaagccaaaagaagaatgctggaggcatcacgctacctgacttcaaactgtactacaagtctacaataaccaaagcagcattgtactggtacaaaaacagagatatagatcaatggaacagaacagagccctcagaaataatgccacatatctacaaccatgtgatctttgacaaacctgacaaaaacaagcaatggggaaaggattccctatttaataaatggtgctgggagaactggctagccatatgtagaaagctgaaactggatcccttccttacaccttatacaaaaattaattcaaaatggattaaagacttacatgttagacctaaaaccataaaaaccctagaagaaaacctaggtaataccgttcaggacataggcatgggcaaggacttcatgtctaaaacaccaaaagcaatggtgacaaaagccaaaattgacaaatgggatctaattaaacttaaagagcttctgtgaagtgaaagaaactaccatcagagtgtacctacaaaatggcaacctacaaaatgggagaaaattttcacaacctactcatctgacaaaaggctaatatccagaatctacagtgaactcaaacaaattttcaagaaaaaaacaaacaaacccatcaaaaagtgggtgaaagatatgaacagacacttctcaaaaaaagagaaaatgcagccaaaatgtgtttatgcagccaaaaaacacatgaaaaaatgttcatcatcactgtccatcagagaaatgtaaataaaaccacaatgagataccatctcacacccattagaatggcgatcattaaaaagtcaggaaacaacaggtgctggagaggatgtggagagaaaggaacacttttacactgttggtgggactgtaaactagttcaaccattgtggaaattagtgtggttattcctcagggatctagaactagaaatacaatttgacccagccatcccattactgggtatatacccaaaggactataaatcatgctgccataaagacacatgcagatgtatgtttattgtggcactattcacaatagcaaacacttggagtcaacccaaatgtccaactacaatagactggattaagaaaatgtggcacatttacaccatggaatactatgcagccataaaaaatgatgagttcatgtcctttgtagggacgtggaagaaactggaaaccatcattctcagcaacctatcgcaaggacaaaaaaccaaacaaagcatgttctcactcataggtgggaattgaacaatgggaacacatggacacaggaaggggaagatcacattccatggactgctgtagggtgaagggagggggagggatagcattaggagatatacctaatgctaaatgacaagttaaggggtgcaggacaccaccatggcacatgtatacatatgtaacaaatcctcacattgtgcaaatataccctaaaacttaaagtataataataataaaaataaaaaaagaaagttttaactccgtttccaaactgctcaaaaaaaggaaagttcaactctgtgagatgaatgcacgaatcacaaagaagtttctcacaaagattctgtctattttttacgtgacgatatttcctttttcaccatagacctcaaagttctcccaaatatccctttgtagattctacaaaaagacggtttccaaactgctcactcaaaggaaagtttcaactctgtgagatgaatgcaaagatcacaaagaagtttctcagaatgcttctggccacttttaatttgaagatatttccttttgcaccatgggcctcaaagtgataccaaatatccctttgcagattctacagaaagacggtttccaaacggctcaatcaagagaaaggtttaaatctgttagatgaatgcatgcaacacaaagaagtttctcagaaagcttctgtctagtttttatgtgaagatacttcctatctcaccataggccataaggggctcacaaatatccctgtgcagattacatgaaaattctgtttccaaactgctgaatcaaaagaaagcttcaaatctgtgagttgaaagcgcatatcacaaagaagtttctcagaaagcttctgtttagtttgcttctgtttagtttttatgtgaagatatttcctttttcatcataggtctcagagcacttcaaatatccatgtgcagattctaaaaaaagagtgtttccaaactgctctatctaaagaaatgttcaactttctgagatgaaagcacacaacacaaagaagtttctcagaaagattctgtctagtttttatgtgaacatatttcctttttcactatagccctcaaatggctcccaaataactctttgtagattctacaaaaagactctttccaaattgctcaatcaaaagaaaggctcaaatctgtgagatgaatgcactcatcagaagaactttctgagacagcttctttatagtttttatgtgaagatatttcctttttcaccataggcattaaatcactgagaaatatccctttgcagatactacaaaaagatgggttccaaactgctcaatcaaaagaaaagttaaactgtgtgagatgaatgcacacatcacaaagaagtttctcagaatctttctgtctagttttcatatgaggatatttaatttttcaccatagtcctcaaagggctcccaaatatccctttgaagattctacaaaaagactctgtcctcactgctcaaaagaaaggatgaactctgttagttcaatgcacacatcaaaaagaagttactcagaaagattctgtctagttttttgagaggatatttccattttcaccaaaggccccaaactgctcagaaatatcccatttcagattctacaaaaagactgattccaaactgctcagtcaaaagaaatttcaacactgtgagatgaatgcacgcatcacaaagaagtttcttagaaaccttctgtctagtttttatgggaagatatttcctttttcaccataggcctcaaagcaccctcaaatatcacattgcagattctacaaaagactttttccaaactgctaaatcaaaagaaaggttcgaatctgcgagatgaatgcacacatcagaaaggagtattacagaaaatttctgtctagtttttatgtgaagataattcctttttaaaataggccacaaagtgctaccaaataacccatcgtagattctagaaaaagaatgtttacaaactgcttaatcaaaagaaagtttcaactctatgagatgaatgcacacatcactaagaagtttctcagaaagattctgtctagtttttatgtgaagatattcccttttttaccataggcctcaaaccgatcagaaatatccctttgtagattttataaaaagactgtttccataatgctcaattaaaagtaaggttcaactctgtgagttgaatgcacacatcaccaaggagtttctcagaatgcttctgcctagttttttgtgaagatattccctttttcaccaaaggtctcaaaccgctctgaaatatctgtttgcagattatagaaaaagactatttccaaattactcaaataaaagaaaggttcaactctgtgagatgaatgcactcattacaaagaagtttctccaaaagcttctgtctagtttttatgtgaagatatttcctttttcaccatactcctcaaagggttcccatgtatccgtttgaagattctacaaaaaatttgtttccaaattcctcaatcaaaagaaaatttcaactctgtgagataaatgcacgcatcacaaagaagtttctcacaaagcttctgtttagtttttacgtgaagacatttactttttcaccacaggattcaaagcaccctcaaatatccctttgcagactctacgaaaagagtgtttccaaactgctcaatcaaaacaaaggttcaactctgtgaaatgaatgcacacataacaaagaaatttctcagaaaacttctgtctagttcttatgtgaagatattcactttttcattatgggcctcaatgggatcccaaatatcccttttcagatcctacaataagactgtttccaaactgttcaatgaaaagaaaggattaattttgtgagatggatgcacacatcaaaaagaaatttctcagaaagcttctgtctagtttttatgtgatggtgtttcctttttcaccataatcctcaaaccaatcaaaaatattcctttacagattcaacaaaaagactgtttacaaactgctaaatcaaaagaaatttcaactctgtgagatgaatgcacacatcccaaagaagtttctcagaaagcttctgtatagttttaatgtgaagatatatccattttcaccataggggtcaaacctctcagaaatatccctttgcacattctagaaaaagactgtttcaaaactgctcaatcaaaggaaaggttcaactctgtgaaatgaatgcacgcatcacaaagaagtttctctgaaagcttctgtctagtttttatttgaagatatttgctttctcactgcaggcatcaaaccactcagaaatatccctttgcagattctacaaaaagactgtttaaaaactacttaaaagaagaaaggttcaactctgtgagatgaatgcacacatcacaaagacgtttctcagaaagcttctgtctagtttttatgggaagatagtctccttttcaccataggcctcaatgggatccagaatatccctttgcagattctacaaaaactgtttccaaactgcccaatcaaaagaaaggttcaacactgtaagatgaatgcacccatcacaaagaagtttcccagaatgcttctttctagttttcatttgaaggtatttcctttttcaccattggcctcaaatcgctcagaaatatccctttgcagattctacaagaaggctgattccaaaatgctaaatcaaaagaaagattcaactgtgtgagatgaatgcacacatcccaaagaagtttctcagaaagcttctttctaatttttatgtgaagttatttcctttttcaccgtaggctgaaaaacgccccaaaaaagtccctttgcagattctacaaaaagactgtttccaaaatgctcaatcaaaagaagggttcgactctgtgagacgaatgcacacatcataaaaaagttactcagaaagcttctgtccagtttttatatgaagatattttggttttcaccataggcctcaaaatgctcagaaacatccttctgcagattctacaaaaagactctttccaaactcctcaatcaaaagaaagtttcaagtctgtgaaatgaatgcacacaacacaaagaagtttctcagaaagcttctgccaaattcttatgtgaagatattccctttttcaacatgtgccacaaggggatccaaatatcgctttgcagattctgcaaagactgtttccaaactgctcagtctaaagaaaggttcaaccctgtgaggtgaatgcacgcatcacaaagaagtttctcagaaaggttctgtctagttcttatgtgaacatatttcctttttcaccttagacctcaaagtgctcccaaatatccctttgcagattctagagagtgactttttcaaactgctcaatcaaaaggaaagttcaactctgctgtttgaatgcatacatcatacagaagtttcacggaaaccttctgtctagttattatgtgaagctatttccttattcaccataggcctcaaactgctctgaaatatccctttgcagattctagaaaaagactgtttccaaactgctcaatcaaaagaaatgttcaactctgtgagatgaatgcacacatcccaaagaagcttctcaaaatgcttctgcctagtttttatgtgaagatatttactttttcaccataggcctcaaagtgctcccaaatttccctttggagatgaatgcatgcatcacaaacaattttctcagaaagcttctgtctagatttatgtgaagatattcactttttcaccataggcctcaaagtgcagattctagaaaaagacagtttcaaagctgctcaatcaaaagaaaggttcaactctgtgagatgaatgcacacatcatagagtactttctcagaaagcttctgtctagtttttatgtgaagatatttcctttttcaacatagacctcaaaccactcagaaatgtcccttggaagaatctacaaaaagactgtttccaagccactcaatcaaaagaaagtttcaattctgtgagatgaatgcacacatcacaaacaagtttctcagaaagcttctgtctagtttttatgtgaagatattccatttttcaccagaggcctcaaagggatccaaagtatccctttgcatattctacaaaaagactgtttccaaaatgcttaatcaaaagaaaggttcaactctgtccaatgaatgcacccatcacaaggaagttatggagaatgcttctttctagttttcatttgaagatatttccttttttaccataagcctcaaatcgctcagaagtatcactttgcagattctacaaaaagactgtttccaaactgctcaatcaaaagaaaggttcaactctgtgagatgaatgcacacatcccaaagaagttctgagaaaacttctgtctagtttttatatgaagatatttcctttttcaccataggcctcaatgggcttccatatatccctttggagattctacaaaaaagagtgtttccaaaatgctcaatcaagagaaagtttgaactcagtgagatgaatgcacgcatcacaaaggagttcctcagaaagcttctgtcgagtttatatatgaaggtatttcctttgtcaccataggcctcaaaatgctcagaaatatcccttggcagattttacaaaaagtctgtttccaaactgctcaatcaaaagaaagtttcaattccatgagatgaatgcacacatcacaaacaagtttctcagaaagcttcggtctagtttttatggaaagatattccctttttcaccatagacctcaaagggatcccaaatatccctttgcatattctgtagaaagtttccaaactgctcaatcaaaggaaaagttcaactctaagagttgaatacagacatcacaaatttcttagaaagcttttgtcttgtttttatgtgaagacatttcctttttcacgataggcctcaaagcgccctcaaaaatcccattgcagattctagaaaaagaatgattccaaactactcaatcaaaagaaaggttcaattctgtgagatgaatgcactcactagaaagaagtttcccagaaagcttctgtctagtttttatgtgaagatatttcctttttcaccataggcctcaaaacaccctcaaaatatcactttgcagattctacaaaagactgtttccaaactgctcagtcaaaagaaaggttctactctgtgagatgaatgcacacatcacaaaagagtatctcaaaaagtttctgtcttgtttttatgtgaagatatttcctttctcaccataggtctcaatgtgcccccaaatatccctttgcagattctagaaaaagattgttgcaaacagctcaacaaaaagaaaggtcaactctgtgaaatgaatgtgtatatcacaaagaagtttctcagaaagcttctgcccagtttttatgagaagatatttccattttcaccataggcctcaaactgctcagaaatatccctttgaaaatattacaaaaagactgtttccaaactactcaatcaaaagaaaatctcaactctgtgagatgaatacacttattacaaagaaatttctcagaaagcttctgtctagtttttatgtgaagatatttcctttttcaccataggcctcaaagcgccctcaaatttcactttgcagtttctacaaaagactgtttccaaactgctcaatcaaaagaaatgttcaactctgcaagacgaatgcacacatcccaaaagagcatctcagaaaatttctatgtagcttttatgtgaagataattcctttttaaaaataggcctcaatgtgctcccaaataacccattgcagatcctagaaaaagagtgtttccaaactgctcaatcaaaagaaaggttcatctctgtgacatgaatgcacatatcacaaagaagtttctcaggaagcttccgtatagttttaatgtgtagatatatcctttttcaccataggcctcaaactgctcagaaatacccattgcagattctagaaaaagaccgttttgaaactgctcaatcaaaggaaaggttcaactctgtgaaatgaatacacacatcacaaagaagtttctcagaatgcttctgtctagttcttatgtgaagatattccctttttcaacatgggcttcaaaaggatcccaaatatcccctttcagattctagaaaaagactgtttccaaacagctcaatcaaaagagaggttcaactctctgaaatgaatgcacacatcaaaagaagttcctccgaaagcttatgtttattttttacatgaagatatttccttcttttcaccttaggcctcaaaccgctcagaaatatcactttgaagtttctcaaaaaaactgtttccaaactgctcaatcaaaagaaaggttcaactctgtgagatgagtgcatggatcacaacgaagtttctcagaaagcttctgtctagtttttatgtgatgatatttccctcttcaccataggcctcgaagggctcccaaatatcctcttgcagattccacaaaaagactgtttccaaaatgctcaatcaaaggaaatttcaaccctgggagataaatgcactcatgacaaagaagtttctcagaaagcttctttctagtttttatgtgaagatatttaattttctaccataggcctcaaagcgcactcaaatatccctttgcagtttctaccaaaagactgttcccaaactgctcaatcaaaaggaagtttcaagtctgtgagaggaatgcacacatcataagatgtttacaagaaagcttctgtctagtttttatgtgaacatatttccttattcaccataagactcaaaccgctgagaaatatccctttgcagattctagaaaaagactgtttccaaaatccttaatcaaaataaaagttcaaatctgtgaggtggatgcacacatcacaaagaagtttctcagaaagcttctgtctagtttttatatgaggatatttcctttttcactgcaggcctcaaaccattcagaaatatccctctgcagattccagaaaaagatgatttccaaactgctcaatcaaaagaaaggttgaactctgtgagatgaatgcactcatttaaaagaagtttctgaggaagcttctgtctagcttttatgtgaagatatttccttttttaccataggcctcaaagggttcccaagtaccccttggcagattctacaaaaagtctgtttccaaactgcttaatcaaaagaatactttaactctgtgagatgaatgcaggcatcacaaagaagtttctcagaaagcccttatctagtttttaagtgaagatatttcctatttcacctttggcctccaagctctctcaaatatcacattgcatattttacaaaaagactgtttccaagctgctgaatcaaaagaaagtttcaaatctgtgagatgaatacaccaatcacaaagaggtttctcagaaatattctgtctagtttttatgtgaagatatttcttttttcatcatatgcctcaaaacactcagaaatatccctttgcatattccaaaaaaaggctgtttccaaactgctcagtcagaagaaaggttcaactgtgtgagatgaatgcacacatcacaaaaagtttctcagaaagctgtcaagtttttatgtgaagagatttcctttttcaccttaggaatcaaagggatcccaaatatccctttgcagattttacaaaaagactgtttccaaactgatcaatcaaaagaaaggatcaattctgagagatgaatgcacacatcagaaaaagttcctgagaaaacttctttctagtttttatgtgaagatattccctttttcaccatagacctcaaaaggctcccgaatatccctttgcagattctacaaaaagactgtttccaagctgctcaatccaaagaaaatttccactctgtgagatcaatgaacacatgacaaacaactttcttagaaagattctgtctagtttttatttgaagatattccctttttcatcataggcttgaaaccactcagaaatatccttttgcagaatctaaaaaaagatggtttccaaactgctcaatcaaaaggaaggtttaactctgtgagatgaatgcattcattacaaagaagtttctcagaaatcttctgtctagtttttacatgaagatatttcctttttcaccataggcctcaaaccactcagaattatccctttgaagattcttcaaaaagactgtttccaaacttcaattataagaaagtttcaactctctgagatgaatgcacacaccacagagaagtttctcagaatatttctgtctagtttttatgtgaagatatttcctttttcaccttaggaatcaaagggatcccaaatatcactttgcagatgttataaaaagactgtttccacactgatcaatcaaaaggaagactttcaccagaggcctcaaagtgctcccaattatccctttgcagtttctacaaaatgaaagtttccaagctgctcaatcagaagaatgtatcaaatctgtgagatgaatgtgcacatcacaaacaagattcttagaaagcttctgcctagtttttatgtgatgatattccctttttcaccatagacctaaaaccatgcagaaatatccctttgtagattctacaaaagactgtttccaaactgctgagtcaaaagaaagtttcaaatctgtgatatgaatgcacacatcacaatgaaatttctcagaaagcttctgtctagtttttatgtgaagatattttctttttcactattggcctcaaaggatgcccaaatatctctttgcagattttacaaagagactgtttccaaactgctcaatcaaaagaaagtttcaactctgtcagatgaatacaagcatcacaacgaagtttctcagaaagcttctgtctagtttttatgtgaaaatatttcctttttcaccataggcttcaaaggcctcccaaatatccctttgcagatttgacaaggagactgtttccaaactgctcaatcaaaaggaaggttcaattctgtgagatgaatgcacacatcacaaagaagtttatcagaaagcttctgtctagtgtttatgagaagacatttactttttcaccataggtcaaaaaccgcacagaaatatccctttgcagtttccacaaaaagactgtttccaaactgctcaatcaaaagaaagggtcaactgtgcgtgttgaatgtacatatcaaaaggaagtttctcagaaagcttctttctagcttttatgtgaagatatttccgttttcaccataggcctcaaagttttcccacatatccctttgcagatcctacagaaagactgtttccaaactgattaatgaaaagaaagtttcaactctgtgagatgcatgcacacctcacaaaagagtttctcaggaaatttctgtctagtttttatacgaagaaaattctttttcaaaataggcctcaaagggctcccaattatctctttgcagattctacaaaaagaatgtttccaaactgctcaatcaaaagaaagtttcaattctgtgagattaatgcacacatcacaaacaagtttctcagaaagcttctgtatagtttttatttgaagatattccatttttcaccataagcctcaaaccactctgaaatatccctttgcagactctagatggctcaatgaaaagaaaggttgaaccctgtgagatgaatgcactcattacaaaggagtttctcaggaagcttctgtctagggtttatgtgaagatatttcctttttcaccataggcctcaaagactccaaaatatcactttgcagattctacaaaaaggctgtttccaaactgctcaatcaaaaggaagttttaactctgtgagatgaatgcaggcatcacaaagaaggttcttagaaagcccctatctagtttttaattgaagatattttctttttcaccattggcctcaaaggtctctcaaatatcactttgcagattctacaaaaagactctttccaagctgttcaatcaaaagtaagttactactctgtgagatgaatgcacacatcacaaagaagttcctcagaaaagttctgtgcagtttttatgtgaagatatttcctttttcaccttaggaatcaaagggatcccaaatatcactttgcagatgttataaaaagactgtttccacactgatcaatcaaaaggaaggttcaattcagtgagaagaatccccacataagaaagaagttcctcagaaaacttcagtctactttttatgtgaagatatcatatttttcaccataggccttgaaggctcccaaatatccctttgcagattctacaaaaggactgtttccaagatgctcaatccaaagaaagtttccactctgagagatgaataaagatatgacaaacaagtttctcagaaagcttctgtctagtttttattgaaagatattacctttctcaccataggcctgaaaccaatcagaaatatccctttgtagaccctaaataagactgtttacaagctgctcaatcaaaagaaaggacagctctgtgagatgaatgccttcattacaaagaattttctcagcaagtttctgtctagtttttatgtgaagatatgtcctttttcaccataggccttaaactggtcagaaatattcccttagacattctagaaaaagactgtttccaaactgctcaatcaaatgaaaggttcaactctgtgagatgaatgcacacatcacaaagaagtttctcagaaagcttctgtctagtttttatgtgaagatattcccttttgagctataggcctttaagctctacaaatatccatttgcagatactacaaaaagagtgtttccaaattgctcaatcaaaagaaaggttcaatgctgtgagttgaatgcacacatcacaaagtagtttctgagaatgcttctgtctagtttttatgtgaagatatttcctttttcaacataggccttaaactggtcacaaatattcctctgcagatactacaaaatgactgtttccaaggtgctccgtcaaaataaaggttcaactctgtgagatgagtgcacacatcacaaagaagtttctcagaatgcttctgtctagtttttatgtgaagatacttccttttacaccataagcctcaaagtgctccaaatatccatttgcagattatacaaaaagggttttcaaactgctcaatcaaaagaaaggttcaactgtgtgagatgaatacacacatcacaaagacgtttctcagaattcttctgtctagcttttatgtgaagataattcctttttcaccataggtgtaaaaacgctcacaaatatccctctgcagatatcacaaaaagactgtttccaaactgctccatcaaaagaaagatacaactctgtgagatgaaagcacacatcacaaacaagtttctcagaatgcttctgtctaatttttatgggaagatatttcctttttcaccgtagacctcaaaaccttctgaatatccacttgcagacactacaaaagactgtttccaaactgctcaatcaaaataaaggttcaactctgtgagatgaaagcacacatcacaaagaagtttcttagaaagcttctttctagtttttaagtgaagatatttcctatttcaccacaggcctcaaagggctcacaaatatccatttgcagattcaacagaaggactgtttctaaactgttcaatcaaaagaaagtttcaactctgtgagatgaatgcacacattgcaaagaagtttctcagaatgcttctttctagtttttaagtgaagatatttcctttttcaccataggctccaaagcattccaaatatcactttgcagattgtgcaataagactgtttccaaagcactgaatcaaaagaaagtttgaactctgtgagatgaatgcacatatcacaaagaagtttctcagaatgcttctgtctagtttttatgttaacatattccctttttcaccataggccttaaacagctcactagtatccatttggagattctacaaaaagactgtttccaaattgctccactagaagaaagtttcaactctgtgagatgaatgcatgcatcacaaagaagtttctcagaatgcttctgtctactttttatgtgaagatatttcctttttcacgataggcttcaaaacgctcaaaatatccatttgcatatacttccaaaagagtgtttccaaactgctcaatcaaaagggaggttcaactctgtgagatgaaagcacacatcatagagcagtttctcagaaggattctgtctcgtttttatgtgatatttctgatttaacagtaggccacaaagggctcaaaaatatttctttgcagattctacaaaaagactgtttccagactgctcaatcaaagaaaggttcaaatctgtgagatgaattgacacatcacaaagaagtttaaaagaattcttctgtctattttctatgtgaaggtacttctttttcaccataggcctcaaatgactcgaaaatatccccttgcagactgtgtaaaaagactgtttccaaactgctctatcaaaagtaaggctcaactctgtgagatgaatgcacacatcacaaaggagtttctcagaatgcttctgtctagtttttatgtgaatatatttcctttttcaccatagacctcaaagcactccaaatattcatttgcagattcttcaaaaagcccatttccaaactgctcattcaaaagaaacgttcaaccctgtgagactaatgcacacatcacaaagtagtttctcagaaagcttctttctagttcttttgtgaagatatttccttttttcaccataggctgcaaagcacagcaaatatccatttgcagattctacaaaaagactgtttccaaactgctcaataaaaagaaatgttcagttctgtgagatgaatggacacaacacaaagaagttcctcagaatgcttctgtcttgtttttatgtgaagatacatcttttccactgtatgtctcaagaggcttggaactatccctttgaagattgtacaaaatgctgtttccaaacttctcaatcaaaagaaattttcaactctgtgagatgaatgaacacatcacaaagaagtttctcagaaagattctgcttagttttaatgtgaaggtatttccttttcaaccataggcctaaaatcactccaaaaatccatttgcatattctacaaaaagaatgtttccaaactgctcaatcaaaagaaagtttcaagtctgtgaggtgaacgcacacctcatgaagaagtttctcagaatgtttctgtctagtttttcagttaagatatttcttttttcaccatagacattaaaccactcagaaatatccctctgcagatactacaaaaaaactgtttccaaactattctatcaaaagaaaggttcaacactgtaagaagaatgcacacatcacaaagacgtttctcagaatgcttctgtcttctttttatgtgaagatatttccttttgcaacataggcctcaatcactccaaatgtcattttgcagattcttccaaaagactgtttccaacctgctcaagcaaaagtgagtttcaactctgtgagatgaatggaagcaacagaaggaagtttcttagagttcgtctatctagtttttatatgaagatacttatttttcaccataggcttcaaaggactcggaagtctccctttgcagattgcacaaaaagactgtttccaaactgctctaccaaaagaaagattcaactctgtgagatgagtgcacacatcacaaagaagtttctcagaatgcttctgtgtagtttttatgtgaaggtacttcctttttcaccatagacctgaaagcactccaaatagccatttgcagatattacaaaaagagtgtttcaaaacggctcaatcaaaagaaagtttcaagtctgggagatgaatgcacacatcacagagaagtttctcagaatgttcctgtctggtttttatgtgaagatatttcctttttcaacataagccttaaactggtcacaaatattcctctgtggataccacaaaaagactgtttccaatgtgctccatgcaaagaaaagttcagctttgtgtggtgaaggcacacatcacaaagaagtttctcaggatgcctctctctagtttttatgtgaagatacatcctttttcaccacaagcctgaaagcgctccaaatatccatttgcatattctacaaaaagagggtttccaaactgctcaaacaaaagaaagattcaaccatgtgaaatgaatttacacatcacaaagaagtttctcagaattcttctgtctagttttatgtcaagataattcctttttcaccataggctttaaacagctcacaaatatccttctgcagatactacaaaaagactgtttccaaactgctccctcaaaagaaatgtagaaaggaaggtgagatgaaagcacacatcataaagaagtttctcagaatgcttccatctagtttttatgtgaagacgtttccttttccaccataggcctcaaagcacggaaaatatccagttgcagattctacaaaaagagtgtttcaaaactgctcaatcaaaagaaaggttcaaatctgtgaggtgaatgcacacatcacaaagaagtttctcagaatgcttccatctagtttttaggtgaatatatttccttttccaccataggcttcaaagcgctccaaatatcctcttgcagattctacaaaaagagtgtttcaaaacttctcaatcaaaagaaagtttcaactctgtgagatgaaagcataaatcacaaagaagtttctcagaaggcttctgtctagttttcatgtgaagatatttccttttgaaaatagcctgcaaagcgttctaaatatccatttgcagatactataaaaagactgtttccaaactgctctattgaaagttcaactctgtgagatgaatgcagacataacaaagaagttgctgagaatgcttctgtctagtttttatgtgaagatatttccttaaccaccacaggcaaccaagcactacaaacatccacttgcagattctacaaaaagagtgtttcaaaactggtcaatcaatagaaatgttcaactctgtgagttgaaagcaagcatcacagagaagtttctcattaagcttctgtctagtgtttatgggaagatattttcttttatgccatagcccaataagtgccccaaataaccacatgcagacactacaaaaagagtgtttcaaaactgctcaatccaaagaaagattgtactctatgagatgagtgcagacatcacaaagaagtttccgagaatgcttctctctagtttttatgtgaagatatttcattttccaccatagcccaccaagcactacaaatatccacttgcagattctacaaaaagagtgtttcaaaactgctcaatcaatagaaatgttcaactctgcgagttgaatgcacacatcacagagaagtttctcataatgcatctctctagtgtttatgtgaagatatgtatttttccaccacagcccactaagtgcctcaaatacccacttgcagattctacaaaaagtgtgtttcaaaactgcccaatccaaagaaagattcaactctatgaaatgaatgcaggcatcaaaaagaagtttctcagaaggcttctgtctagtttttatgagaagatattcccttttccacaataggcctcaaagtgctccaaatatcctcttgcagattctacaaaaagagtggttcaaaacttctcaatcaaaagaaatgttcaactctgtgagatgaatgcacacatcacaaagcagtttctcagaatgcttctgtctagttttcatgtgaagatatttacttttcaaaataggccacaaagcactccaaatatccatttgcagatactacaaaagactgtttccaaactgctctatcaaaagttcaactctgtgagacgaatgcagaaatcacaaagaagtttctcagaaggcttctgtctagttgttatgtgaagatatttcattttccatcataggccaccaagcactacaaatatcaactagcagcttctacaaaaagagtgttttaaaactgctcaatcaataaaaaggttcaactctgtgagttgaatgcacacatcacagagaagtttctcataatgcttctgtctagtgtttacatgaggataatgtttttctgccacagcccactaagcgcattaaatacccacgtgcagattctacaaaaagagtgtttcaaaactgctcaatctaaagaaagattgaactctaagagatgaatgcagacatcaaaaataagtttctcagaaggcttctgtctagttttcatgtgaagataattcattttccatcatagtccaccaagcaccactaatacccacttggagattctacaaaaggagtgtttcaaaactgctcaatccaaagaaacattcaactctatgagacaaatgcacgcatcacaaagaagtttctcagaatgcttctgtctagtttttgtgtgaagatattcccttttccaccataggcctcaaagcgctccaaatatcctcttgcagattctacaaaaagactgtttcaaaacttctcagtcaaaagaaaggtgaaactctgttagttgaatggacacatcacaaagcagtttctcctaatgcttctgtctagttttcatttcaagatatgtccttttcaaaataggcctcaaagcactccaaatatccatttgcagatactacaaaaatactgtttccaaactggtctatcaaaagttcaactctgtgagatgaatgctgacatcacaaagaagattctgagaatgcttctgtctagtttttatgtgaagatatttcattttccaccataggacaccaagcactacaaatatccacttgcagattctacaaaaagagtgtttcaaaactgctcaatcaatagaaaggttcatctctgtgagttgaatgcacacatcacagagaagtttctcataatgcttcagtctagtgtttacgtgaagatatttttttcctccatagtccactaagcgcccacaatacccacttgcagattctacaaaaacagtgttccaaaactgcttaatccaaagaaagattcaacattatgagattaatgcagacatctcaaagaagtttctcagaaggtttctgtctagtttttatgtgaagatattttattttccaaaataggcattcaagcactacaaatatccacttgcagattctacaaaaagagggtttcaaaactgctcaatcaatagaaagtttcatctctgtgagttgaatgcacacatcacagagaagtttctcataatgcttctgtctagtgtttacgtgaagatatttttttcctccatagcccactaagcgcccacaatacccacttgcagattctacaaaaacagtgttccaaaactgctcaatccaaaagaaagattcaactttatgagattaatgcagacatctcaaataagtttctcagaaggtttctgtctagtttttatgtgaagatattttattttccaaaataggcaatcaagcactacaaatatccacttgcagattctacaaaaagagggtttcaaaactgctcaatcaatagaaagtttcatctctgtgagatgaatgcacacatcacagagaagtttctcataatgcttctgtctagtgtttatgtgaagatatttttttttctgccatagcccactaagcgcccaaaatacccacttgccgattctacaaaaagagtgtttcaaaactgctcaatacacagaaagattgaactctgtgagatgaatgcagacatcacaaagaagtttctcagaaggcttctgtctagttttatgtgaagatatttcattttccaccataggccaccaaacactacaaatatctacttgcagattctacatgaagagtatttcaaaactgctcaatcaacagaaaagttcaactctgtgagttgaatgcaaacatcacagagaagttattcataatgcttctgtatagtatttatgtgaagatatttttttccaccatagcccactaaacgccccaaatacccacttgcagatactacaaaaagagtgtttcaaaactgctcaatccaaagaaaaattcaactctatgagaatgcatgcatcacaaagaagtatctcagaatgcttctgtctagtttttatgtgaagatattcccttttccaccataggcctcaaagcactccaaatatcctcttgcagaatctacaaaaagagtgtttcaaaacttctcaatcaaaacaaagtttaaactcttttatttgaatgcagacatcacaaagcaatttctcagaatgcttccgtctagttttcatttgaagatatgaccttttcaaaataggcctcaaaacactccaaatatccatttgcagatactacaaaaagactgtttccaaactgctctatcaaaagttcaactctgtgagatgaatgcagatatcacaaagaagtttctgagaatgattcagtctagtttttatgagaagatatttcattttccaccataggcaaccaagaactacaaatatccacttgcattttctgcaaaaagagtgtttcaaaactgctcaatcaataggaaggttcaactctgtgagttgaatgcacacatcacagagaattttctcatataatgcttctatctagtgtttatgtgaagatattttcttttctgccatagcccactaagcaccccaaatacccacgtgcagattctacaaaaagagtgcttcaaaactgctcaatccagagaaagattcaactctatgagatgaatgcagacatcacaaacaggtttctcagaaggcttctgtctagtttttatgtgaagatatttcattttccaccataggccaccaaccactacaaatatccacttgcagattctccaaaaagagtgtttcaaaactactcaatcaatagaaaggttcaactctgttagttgaaagcacacatcacagaaaagtttctcataatgcttctgtctagtgtttatgtgaagatatattttttctgccatagcccactaaacgccccaaatacccacttgcagattctacaaaaagagtgtttcaaaactgctcaatcaaaagaaagattcaactctatgagatgaatgcacacatcacaaagaagtatctcagaatgcttctgtctagtttttatgcgaagatattcccttttccaccataggcctcaaaacactctaagtatcctcttgcagattctacaaaaagactgtttcaaaacttcccaatcaaaagaaaggttaaactctgttagttgaatgcacacatcacaaaacagtttctcagaatgcttctgtctagttttcgtttcaagatatgtccttttcaaaataggcctcaaagcactccaaatatccatttgcagatactacaaaaagactgtttccaaactgctctatcaaaagatcaactctgtgagatgaatgcaggcatcacaaagaagtttctgagaatgcttctgtctagtttttatgtgaagatatttccttttccacagtaggcctcaaagcactccaaatacccacttgcagattcttcaataagagtgtttcaaaactactcaatcataagataatttcagccctgtgagaagaatgcacacatcactaagaagcttctcagaatgcttctgtgtagtttttatttcaagatatttccttttccaccatgggctgcaaaggactccaaagatccacttgcagattctacaaaaagagagattcaaaactgttcagtcaaaagatatgttcaactctgtgtgttgaaagcacaccacacaaagaggtttctcagaacgcttctgtgtagtttttatgtgaagatatttccttttccaccatgggccccaaagcactccaaatatccacttgcagattctacagaaacagtgtttcgaagctgctcaatgaaaggacatgatcaactctgtgagatgaatgcacacatcacaaagaagttactcagaattctactgtgtagtttttatgggaagatatttctttttccacaataggctacaaagcggtacaaatatcttcttgtagattctaaaataagagtgtttccaaactgctcaatcaaaagataggttcaattctgtgagttgaatttacacatcacagagaagtttctcagaatttcttctgtgttgtttttatgtgaagatatttcctgatccacaatatacatcaaagctcttcaagtatccacttgcagattctgcaaaagagagatgcaaaactgctcaatcaaaagataggttcgatggtgtgcattgaatgcacacatcacaaagaagtttctcagaatgcttatgtgtagtttttatgtgaagatattttcttttccacattaggcctcaaagcactcccaatctccacttgcagactctgtgaaaagagagattgaaaactgatcaatcaaaatgtagcttcaactctgtaagttgaatgctcacatagcaaagaagtttctcagaatacttttgagtaatttttatgtgaagatatttccttttccaaaattggcctcaaacccctccaaatatccacttccagattttataaaaagagtttcaaaactgctcaatgaaaagagagattcaaatctgtgtgatgaatgcactcatcacaaaggagtttctctgattgcctctgtgcagtttttatttgatgaaatttccttttccaccatagggtgcaaagggctcgaaatatctactttcagattctacaaaaacagagattcaaaactgctcaataaaagaaaggttcaactctgttagttgaatgcacacatcacaaagaggtttctcagaatgcttctgcctagttttcatctgaagatacttccttttccaaaagaggatgcaagcgctctaaatatccacttgcagattctacaaaaagagtgtttccaaactcctcaatcaaagcaaagattccattctgtgagttgaatgtacacatcacaaagaagtttctgagaatgcttctgtctagtttttatgtgaagatacttccttttcagctataggactcaaagcactccaaatattcttttacagaaactacaaaaagagtgtttccaaactactcaatcaaagcttcagctctctgtgttgaatgcacacatcagaaagtagtttctgagaatgcttctgtctagtttttgtgtgaagatatttccttttcagctataggcctcaaagcactccaaatatccatttgcagatactacaaaaagagtgtttgaagctgctcaatcaaaagaaatcttcaactctgtgtgatgaatgcacacattaccacaaaggttctgagaatgcttccatctagtttttatgcaaagatatttccttttcaactataggcctcaaagcactcccaaatatccacttgcagatactacaaaaagtgtgtttccaaactgctcaatcaaaagaaaggtgcaactctgtgagttgaatgcacacatcacaaagaagtttctgagaatgcttctgtctagtttttgtatgaagatatttccttttccaccttaggcctcaaagcactccaaatatccacttgcggattctacagaaagtttgtttcaaaacagctcaatgaaaataaaagttcaactatgtgagatgaatgcacacatcacaaagtagtttctcaaacacttctgtctagtttttatatgaagattttttccttttcagctataggcctctaagggttcaaaatatacatttgaagatacatactataaagagtatttccctacagctccatcaaaagaatggttcaactccgttagttaaatgcacacctcacaaagaagtttctgagaatgcttctgtctagtttttatgtgaagatatttccttttcagctataggcctcaaagcactccaaatatccatttgcagacactacaaaaagagtgtttcaaaactgctcagtcaaaagaaatcttcaactccgtgggatgaatgcacacattaccaggaaggttctgagaatgcttccatctagtttttatgtgaagatatttccttttctgctacaagccaaaaagcactccaaataaccatttgtagatactacaaaaagagtgtttccaaactgctcaatcaaaaaaaaggttcaactctgttacttgaatgcacgaatcccaagaaacttctgagaatgcttctgtctagtttttatgtgaagatattttcttttccaccatagccctcaaagcgctccaaatatccacttgcagattctacaaaaagagtgtttcaaaactgctcagtcaaaagaaagtttcaactctgtgagatgaatgcaaacatcacaaagaacattctcagaatgcttctgtctagtttttatgtgaagatatttccttttcagttgtaggcctcaaagcacttcaaatatccatttgcagttaccacaaaaagagtgtttccaaactgatcaatcaaaagaaaggttcaccactgtgagttgaatgcacacatcacaaagaagtttctgataatgcttctgtccggttttgatgtgaagatatttccttttctaccataagccagaaagtgctccaaatatccatttgcagattctacaaaaagagtggtcccaaagtgcccaatcaaaagaaaggtacaactctgtgagatgaatgcacacatcacaaagaagtttctcagaatgcttctgtctagtttttatgtgaagatacatccctttccaccataggcctcataacactccaaatatccatttgcaggtactataaaaagagtatttccatttgaactttaaagtggtttttccaattctgtgaagaaagtcattggtagcttgatggggacgacattgaatgtgtaaattaccttgggcagtatggccattttcatgatattgattcttcctacccatgagcatggaatgttcttccatttgtttgtatcctcttttatttcattgagcagtggtttgtagttctccttgaagaggtccttcacatcgcttgtaagttgaattactaggtattttattctctttaaagctattgtgaatgggagtacactaattatttggctctctgtttgtctgttattggtgtgttagaatgcttctgatttttgtacattgattttgtatcctgagactttgctgaagctgcttatcagcttaaggagatttggggctgagacaatggggttttctagatatacaatcatgtcgtctgcaaacagggacaatttgacttcctcttttcctagttgaataaactttatttccttctgctgcctaatttcccttgccagaacttccaacactatgtcgaatagaagtggtgagagagggcatccctgtcttgtgccaattttcacaggaaacgcttccagtttttgtccattcagtttgatattggctgtgggtttgtcatagatagctcttattattttgagatacgtcccattgatacctaatttattgagagttttttgcatgaaggatggttgaattttgtctaaggtcttttctgtatctattgagataatcatgtggtttttgtctttggttctgtttatatgctggattacatttattgatttgcatatattaaaccaggcttgctccccagggatgaagtccacttgatcatgatggataagctttttgacgtgctgctggattctgtttgctagtattttattgaggatttttgcatcaatgttcatcaaggatattggtctaaaattctcttttttggttatgtctctgcccgtctttggtatcaggatgatgctggtctcataaaatgtgttagagaggattctttctttttttattgattggaatagtttcagaaggaatggtaccagttcctccttgtacctctgggagaattcggctgtgaatccatctggtcctggactctttttggtaggtaatctattgattattgccacaattttagagcctgttactggtctattcagagatttaacttctttctggtttagtcttgggagggtgtatgtgtaggaatttatccatttcttctagattttccagtttatttgtgaagaggtgtttgtagtattctctgatggtagtttgtatttttgtgggaccagtggtgatatcccctttattattttttattgcgtctatttgatttttcttcctttttttctttattagtcttgctagtggtctgtcaattttgttgatcttttcacgaaaccagctcctggattcattaagtttttgaagagttttttgtgtctctatttccttcagttctgctctgatgttagttatttcttgccttctgctagcttttgaacgtgtttgctcttgcttttctagttctattaattgtgatgttagggtgtcaattttggatgtttcctgctttctcttgtgagcatttagtgttacaaattttacgctacacactgctttgaatgtgtcccagagattctggtatgttgtgtcttcgttttcattggtttcaaagaacatctttgtttctgccttcatttcgttatgtacccagtagtcattcaggagcaggttgttcagttttcatgtatttgagcggttttgagtgagtttcttaatcctgagttctagtttgattgcactgtggtctgagagacagtttgttataatttctgttattttgcatttgctgaggtatgctttacttccaactatgtggtagattttggaataggtgtggtgtggtgctgaaaaaaatgtatattctgttgatttgaggtggagagttctgtagatgtctattaggtccgcttggtgcagagctgagttcaattcctgggtatctttgttaactttctgtctcattgatctgtctaatgttgacagtggggtgttaaagtctcccattattattttgtgggagtctaagtctctttataggtcactcaggacttgctttatgaatctgggtgctcctgtattgggtgcatataaatttaggatagttagctcttcttgttgaattgattcctttaccattatgtcatggccttctttgtctcttttgatctttgttggtttaaagtctgattattcagagactaggattgcaacctctgcctttttttgttttccattttcttggtagatcttcctccatccttttattttgagtctatgtgtgtctctgcccatgagatgggtttcctgaatacagcacactgatgggtcttgactctttatccaatttgccagtctttgtcttctaattggagcatttagtgcatttacatttaaagttaatattgttatgtgtaaatttaatcctgtcattattattttagctggtcattttgctcgttaattgatgaactttcttcctagcctagatggtctttacaatttggcaggattttgcagtggctgctaccagttgttcctttccatgtttagtgcttccttcaggagctcttttagggcaggcctggtggtgacaaaatatctcagcctttgcttgtctgtaaaggattttatttctccttcacttatgaagcttagtttggctggatatgaaattctgggttgaaaattctttcctttaagaatgttgaatattggcccccactctcttctggctattagagtttctgccaagatccgctgttagtctgatgggcttccctttgtgggtaacccgacctttctctctggctacacttaacattttttccttcatttcaactttggtgaatgtgacaattatgtgtcttggagttgcccttcttgagtagtatctttgtggtgttctctgtatttcctgaatgtgaatgttggcctgcctttctagattggggaagttctcctggataatatcctgcagagtgttttccaacttggttccattctccccgtcactttcaggtacaccaatcagatgcagatttggtcttttcacatagtcccatatttcttggaggctttgttcatatgtttttattctttgttctctaaacttcccttctcacttcatttcattcatttcttcttccatcactgataccctttcttccagttgatcgcatcatctcctgtggcttctgcatttttcatgtagttctcgagccttggctttcagctccatcggcttctttaagcacttctctgtattggttattctagatatacattcatctgaattgttttcaaagtttttaacttctttgcctttggtttgaatgttctcttgtagctcggagtaatttgatcgtctgaaggcttcttctctcaactcgtcaaagtcattctccattcagctttgttccattgctggtgaggaactgcattcctttggaggaggagaggcactctgctttatagagtttccagtttttctgctctgtttttaccccatctttgtggttttatctacttttggtctttgatgatggtgatgtacagatgggtttttggtgtggatgtcctttctgtttgttagttttccttctaacagtcaggaccctcagctgcaggtctgttggagtttgctagaggtccactccagaccctgtttgcctgggtatcagcagcagtggctgcagaacaacagattttcatgaaccacaaattctgttgtgtgatcactcctctggaagttttgtctcagaggattacccggccatgtgaggtgtcagtcttgcccctactgagaggtgcctcccagttaggctgctcggaggtcaggggtcagggacccacttgaggaggcagtctgctcgttctcagatctccagctgtttgctgggagaaccactgctcccttaaaagctgtcagaaagggacatttaagcctgcagaggttactgttgtctttttgtttgtctgtaccctgcccccagagatggagcctacagaggcaggcaggcctccttgagctgtggcaggctccaccaagttcgagcttcctggctgctttgtttgcttaagcaagcctggtcaatggcgggtacccatcccccagcctcaatgccacggtgtagtttgatctcagactgctgtgttagcaatcagcgagactccatgggcataggaccctctgagccatgtgtgggatataatctcctggtgtgccattttgtaaccccatcggaaatgtgcaggattagtgtgggagtgacccaattttccaggtgccgtctgtcacccgtttctttgactaggaaagggaactgcctgacaccatgtgcttcccgagtgaggcaatgtttcaccttgctttggctcccacaaggtgcactgcacccactgtcctgcgcacactgtctggcgttccctagttggatgaacccagtaactcagaaggaaaggcagaaatcagccgtcttgtacatcgctcacactgggagctgtagaacggagctgtacctattcagccatcttggctgccaggtcctgatttcctgaaattttcttttgattgagcagctttgaaacactctttgtagtatctgcaaatggatatttggaacacttcaaggactatagttgaaaaggaaatatcttcacataaaaactagacagaagcattctgagagacctctttttgatgtgtgtattcatctcacagagttgaacctttcttttgattgaacagttttgaaacgttctttttgtagaatctgcaagtggataattggaaagctttgaggcctatggtggaaaacgaaacatcttcacataaaaactagacagaagcattctcagaaactactttgtgatgtgtgtgttatactcacagagttgaaactttcttttgattgactagtttggaaacaatatttttgtagtatcggtaggcaattgggagcactttgatgcctacagctggaaaaggaaatgtctaaacataaatactagacagaagcattctgagaaacttctttgtgatgtgtgccttcatttcacagagttgaacctttcttttgtttgagctgttttgaaacactctttttgtagaatctgaaagtggatatttggaacgctttgaggcctatggtggaaaaggaaatattttcacataaaaactagacaaaagcattctcaggaagttgtttgtaatgtgtgcattccgctcacagagttgaacctttcttttgatagagcagttttgaaacactctttttgtaggatctgcaaatagatatttggagcgttttgagtcctatggtggaaaaggaaatatcttcacataaaaactagtcagaagcattctcagaaacttctttctgatgtgtgcattcaactcacagtgttgaacctttcttttgatagagcagttttgaaacactctttttccagaatctgcaagtggatatttggagtgctttgaggcctatggtggaaaaggaaatatcttcaggcaaaaagtagacagaagcattctcagaaacttctttctaatgtgtgcattgaactcacagagttgaacctttcttttgatagagccgttttgaaaatctctttttttagaatctgcaagtggatatttggtgctcttttagacctatagtggaaaaggaaatatcttcacataaaaactagatagacgcattctcagaaactactttgtgatgtgtgcattcaactcacagagttgaacctttcttttattgagcagttttgaaacactcttttgaagtgactgcaagtgtatattcggagtgctttgaggcatgtactggaaaaggaaatatcttcacatcataagaactagacagaatcattcgcagaaacttctttgtgatgagtgccttcaactgccagaggtgaaccttgagcagttttgaaacattctttttgtagtatctgcaagtggatatttggagcacattgaggccaatggtggaaaaggaaatatcctcacataaaaactagagagaagtattcttagaaattctttctgatgtgtgcattaaaactcacagagttgaaccattcttttgatagagtagttttgaaacactctttctgaagtatctgcaagtgtatattcagagcgctttgaggcctatggtggaagaggaaatatcttcacataggaactagacagaagcattcgcagaaacttctttgtgatgagtattttcaactctcagagtttaacctttcctttgatagagctgttttgaaacactatttttgtagtatctgcaagtggatatttggagcgctttgaggcctatggtggataaggaaatatcctcacataaaaactagacagaagcattctcagaaagttctttgtaatgtgtgcattcaagtcacagacttgaacctttcctttaatggagcagttttaaaacactgtttttgtagaatctgcaagtgagtatttggagcacattgaggcctttggattagaagtaaatatcttcatgtaaatctagactgaagcattctcagaaacgtctttgtgatgtgtgccttcaactcagagagatgaacctttcttttgattgagctgttttgaaacactctttttgtagaatctgaaagtggatatttggaaagctttgaggcctacgatgggaaaggaaatattttcacatagaaactagacaaaagcattcttgagaagttgtttgtgatgtgtgcattccgctcacagagttgaacctttcttttgatagagcagttttgaaacactctttttatagaatctgcaagtggatatttggagcgctttgagccctatggtggaaaaggaaatatcttcacataaaaactagtcagaagcattctcagaaacttctttctgatgtgtgcattcaactcacagtgttgaacctttcttttgatagagcagttttgaaacactttttccagaatctgcaagtggatatttggagtgctttgaggcctatggtggaaaggaaatatcttcaggtaaaaagtagacagaagcattctcagaaacttctttctaatgtgtgcattgaactcacagagttgaacctttcttttgatagagcctttttgaaaatctctttttttagaatctgcaagtggatatttggtgctcttttaggcctacggtggaaaaggaaatatcttcacataaaaactagacagaagcattctcagaaactactttgtgatgtgtgcattcaactcacagagttgaacctttcttttgatagaacagttttgaaacactcttttgaagtgactgcaagtgtatattcggagtgctttgaggcatgtactggaaaaggaaatatcttcacataagaactagacagaatcattcacagaaacttctttgtgatgagtgaattcaactcccacagttgaaccttgaggagttttgaaacacactttttgtagtatctgcaagtggatatttggagtgctttgaagccaatggtggaaaagttaatatcctcacataaaaactagactgcagcaatcttagaaacttctttctgatgtgtgcattcaactcacagagttgaacctttcttttgatagagcagttttcaaacactctttttgtagaatctgcaagtgcacatttggagcgcttttaggcctatggtgggaaaggaaatatcttcacataataactagacagaagcattctcagaaactactttgtgatgtgtgcattcaactcacagagttgaacctttcttttgacagagcagctttgaaacactttttttgaagtatctgcatgtgtatattcagagcgcttcgaggtctattgtggaaaaggaaatatcttcacataggaactagacagaagcagttgcagaaacatctttgtgatgagtgcattcaactcccagagtttaacgtttcctttgatagttcagttttgaaacactcttcttgtattatctgcaagtggatatttggagcgctgtgaggccaatggtggaaaaggaaatatcctcacataaaaactagacagaagcattctcagaaacttctttgtgttgtgtgcattcaactcacagggttgaacctctcctttgattgagcagtttgaaacactctttttgtaggctctgcaagtgtatatttggagcgctttgatgcctatggtggaaaaggaaatatcttcacataaatctagacagaagcattcgaagaaacttctttgtgatgtgtgccttcaactcacagagttgaacctttcttttgatagaaaagttttgaaactctctttttctacactctgcaaatggatatttggagcgctatgaggcatatggtggaaaaggacatatcctcacataaaaactagacagaagcattctcggaaactcctttgtgttgtgtgcattcaactcacagggttgaacctttcctttattgagcagctttaaaaatctctttttgtagaatctgcaattggatatttggagcactttgtggcctgtggtggaaaaggaaatatcttcacataaatctagacagaagcattctcagaaacattactgtgatgtgtgcattcaactcacagatttgaacctttgttttgatagagcagttttgaaacactctttttcttcaatctgcaagtggatatttggagcattttgaggccttggaggaaaaggaaatatactcacataaaaactagatagaagctttctcagaaacttctttgagatgtgtacattcaactcacagagtggaaccttccctttcattgagccatttttgaaaaactgtttttgtaggatctgtaagtcgatatttagagcagattgaggcctatggtggaaaaggaaatatcctcacataaaaactagacagaagtattctcagaaacttctttgtgacatgtgcattgaacctacagagttcaacctttcttttgatagagcagttttgaaacactctttctccggaatctgcaattggatatttggtgtgctgtgaggccaatggtggaaaaggagataccttcacataaaaactagacagaagctttctcagaaacttatttgtgaagtgtgcattcaactcacagagttgaacctttcttttgatagagcctttttgaaactctctttttctacaatctgcaaatggatatttggagccctttgaggcctatgctggagaggaaatatcttcacataaaaactagacagaagcattctcaaaaacttgtttgtgatgactgcattcaactcacagagttgagcatttctattgatacagcagtattcaaacactctttctgtagactctgcaagtggatatttggagagctttgaggcctatggtgaaaaaggaaatatcctcacataaaaactagacagacgcattctcagaaacttctttctgttgtgtacattgaactcacagagttgaaatttacttttgatgaagcagttttgaaacaatctttttgtagaatctgcaagtggatatttggagcgttttgaggcatatgttggaaaaagaaatacctttacataaaatctagagagaagcattctcagaaacttctgtgtgatgtgtgcatttatctcacagagttgaaactttctttttaaagagcagttttgaaacactccttttgtagaatctgcaagtggctatttgggatatttgacgcctatggtggaaaaggaaatatcctcacataacaaccagacagaagcattctcagaaacttctttgttttgtgtgcattcaactcacagtgttgaacatgtcctttgattgcacggttttgaaacactgttttttgcaggatctgcaagtggatatttgcagcgctatgaggcttatgttggaaaagaaaatatctccacataaatccagacagaatcactcacagaaacttctttgtgatgtgtgcactcaaatcacagaattgaacctttcttttgatagaacagttttgaaacactctatttgtagagcttgcaagtggatatttggagctctttggggcctatggtggaaaaggaaatatcctcacataaaaactagacagaaatattctcagaaacttcttatgttgtgtgcattcaactcacagagttgaaactttcctttgattgagaaattttgaaacaatctttttgtagaatcttcaagtggatatttggagtgatttgaggcttctggtggaaaacaaaatatcttcacataaaaagtagacagaagcattctcagaaacttcttcatgatgagtgcattcaactaacagagttgaactttcatttgatagagcagttttgaaacactatttttgtagaatctacaagcagatatttggagcgctttgaggcttatggtggaaaaggaaatatcctcgcataaaaactaaacagaagcattctcagaaacttctttctgatgtgtgcattcaactcacagagttgaaactttcttttgatagagcagttttaaaaccctcttcttctaggatctagaagtggatactcggagcactttggggcctattttggaaaaggaaatatcttcagataaaaactagacagaagcattctcagaaacttctttgtgttgtgtgcattcatctcacagagttgaaactttcctttgattgagcagttttgaaacactctttttgtagaatatgcaagtggatatttggagtgctttgaggcctatggtggaaaaggaaatatattcacataaaagtagactgaagcattctcagaaagttttttgtgatgtgtgctttcaacagacagagttgagccattcttttgatagagcagttttgaaacactctttttgtagaatctcaaagtggatatttggagtgctttttgtggcctatggtggaaaaggaaatatcctcacttaaaatctagacagacgcattctcagaaactcctttgtgttgtgtgcattcaactcacaaggttgaatctttcctttgatagagcagttttgaaacccactttttgtagaatctgcaagtggatatttggagtgttttgaggcctatggtggaaaaggaaatatctttaaataaaagctagacagaaacattctcagaaacttctttgtgatgagggcgttcaactcacagagttgaatgtttctgttgatagaacagttttgtaacactctttttgtagaatctgcaagtggatatttggagtgctttgaggcctattttggaaaaggaatatcctcacttaaaaattagacagaagcattctcagaaacttcttcgtgttgtgtgcactcaactcacagagttgaagctttcatttgattgggcagttttgaaacactctttttgtagaatctgaaagtgaatatttggagcactttgaggcgtatggtggaaaaggaaatatcttcacgtaaaaactagacagaagcattctcagaaacttctttgtgatgtgtgcattcaactcacagagttgaacatttcttttgatagagtagttttgaaaacctccttttgaagaatatgcaagtggatatttggaatgctttgaggcctacggtggaaaagaaaatatcctcacataaaaacaaacaaaaagagtgtttcgaaactgttctatgaaaaggaatgttcaactctgtgagttgaatgcacacatcactaaaaagtttctgagaatgcttctgtctagtttttatgtgaagatattcccgtttaaaccgaaggcttcaatgtgctctaaatatccacttgcagattctacaaaaagagtgtttcaaaacttatctatcaaaaaaaagtttcaactgtgtgagttgaatgcacacatcactaagaagtttctgagaatgcttcggtctagttttcatgtgaagacattcacatttccactgaagacctcaaggctgtccaaatatccacctgcagattctaccaaagagtgtttcaaaactgctctttcaaaacaaaggttcaactctgtgagttgaatgcacacatcacaaagaagtttctgaaaatgcttctgtctagtttttatgtaaagatatccggtttccaatgaaagcctcaaagcggtcaaaatatccacttgcaaattttacaaaaagagtgttccaaaactgctctaatgaaaggaatgttcaagactgtgagttgaaagcaaacatcacaaagaagtttctgagaatgcttctgtcttgtttttatgtggagatatttcctttttcacagaaggcaccaaaaagctccaaatgtctacttgcagattctacaaaaagagtgtttcaaaactgctatatcaaaagaaagtttcaactctgtcagttgaatgcacatatcacaaagaagtttctgagaatgcttctgtctagtttttatttgaagatatttccttttttcaccatagacctcaaagtgctgcaaatactgaattccagattctacaaaagagggtttcaaaactgctctatcaaaataaaggttctactctgtgtgttgaatgcacacatcacaaagtagtttctgagaatgcttctgtctagtttttctgttaagatatttcctttttcagtataggcctcaaagcactccaaatatccacatgcagattctaccaaaagagtgtttcaaaactgctttatcaaaagaaaggttcaactctgtgggttgaatgcacacatcacaaagaagtttctgagaatgcttccatatagtttttatgtgaagacatttcctttttcacgataggcctcaaagtgctccaaatgtccacttgcagattctacaaaaaaagtgtttcaaaactgctttatcaaaagaaacgttctactctgtgagttgaatgcacacatcacaaagcagtttctgagaatgcttctgtctagttttcatgtgaagatatttcctttttcaccataggcctcaaagctctccaaatgcccatttgcagattctccaaagagagagtttgaaaactgctctatcaaaagaaaggttcaactctgtgaattgaatgcacacatcacaaagaattttctgagattgcttctgtctagtttttctttgaagatatttcctttttcaccataggcctcaaagtgctacaaatatccacttgcagattctacaaaaagagtgtttcaaaactgccttatcaaaagaaaggttcaactctgtgggttgaatgcaaacatcacaaagaagtttctgagaatgcttctgtctagtttttatgtgaagatatttcctttttcaccataggcctcaaagcgctccaaatgtccacttgcagattctacaaaaagagtgtttcaaaacggctctatcaagagaaagattcagctctgtgagttgaattcactcatcaaaaagtagtttctgagaatgattctctctagtttttatatgaagatatttactttttcaccatagacctcaatgtgctccaaatgtccactagcagactctacaaaaggagtctttcaaaactgctctatcaaaagaaatgttcaactctgttatttgaatacacacgtcacaaagaagtttctgagaatgtttctgtctagtttttatgtgaagacatcatgtttacaacaaaggtctcaaagctgtccaaatatccactggcaaattctacaaaaagagagtttcgaaactactctttcaaaaagaatattcaactctgtgagttgaatgcatatatgagaaagaagtttctgagaatgcttctgtctagttttcatgtgaagatatttcgttttcaccataggcctcaaagtgctccaagtgtccatttgctgattatacaaagagattgtttcaatactgctctatcaaaatacaggttcaactctgtgagttgaaagcacacatcagaaattagtttctgagaatgcttatgtctagtttttaagtgaagacatttcctttctcaacaaaggcctcaaagcgctctaaatgtccacttgcagattctacaaaaagagagttttgaaactgctctttcaaaaggaaggttcaactctgtgagtggaatgcacgcatcacaaagaagtttctgagaatgcttctgtctagtttttatgtgaagatactcccgtttccaaagaaggcctcaaagcagtcggaaaatccacttgcaaattccgcaaaaacagtgttttgaaaccgctctatcaaagggaatgttcaactctgtgagttgaaagcaaacatcgcaaagaagttactgggaatggttctgcctagtttttatgtgaagatatttccttttacaccctaggcctcaaagcactccaaatgtccagttgcagattctacaaagagattatttcaatactgctctatcaaaagaaaggttcaactctgtgagttgaatgcacacatcagaaagtagtttctgaaaatgcttctgtctagtttttctgtgaagacatttccttttacaccctagtcctcaaagtgctccaagtgtccgtttgcagattctacaaagagattctttcaatactgctctatcaaaagaaaggttccactctgtgggttgaatgcacacatcagaaagtagtttgtgagaatccttctatctagtttttccatgaagatattttctttttcaccataggcctcaaagctctccaaatatccacttgcagattctacaaaaagagtgtttcaaaactgctctatcaaaagaaatattcaactctgtgagttgaatgcactcatcaaagagaagtttctgagaaagattccctctagtttttatgtgaagatatttcctttttcaccgtaggcatcaaagtgctccaaatttccactagcagatacttcaaaaaaagtgtttcaaaactcccctatcaaaagaaatgttcaattcttttagttgaatgcacacgtcacaaagatgtttctgagaatgcttctgtctagtttttatgtgaagatatttccttttcaccataggcctcaaagcgatcaaagtgtccacttgcagattctacaaacagagagtttcaaaacttctctaccaaaagaaaggttcaactctgtgagttgaatgcacacatcacaaagaggttttgaagaatgcttctgtatagtttttatgtgaagatattcccatttccaccgaaggcttcaatgtgctctaaatatgcagttgcagattctacaaaaagagagtttcataactgctctatcaaaaggaaggttccactctgtgagttgaatgcacacatcacaaagaagtttctgagaatgcgtctgtctagtttttatgtgaagatattcccatttccactgtagacctcaaagctctccaaatatccaattgcagattctacaaaaagagtgtttcaaaactgctctatcaaaagaaatgttcaactctgtgagttgaatgcactgatcacaaagaagtttctaagaatgcttctgtctactttttatgtgaagacattcccttttccacagaaggcctcaaagcaatgcaaatatccacttgtagattctacaaaaagagtgtttcaaaactgctctatgaaatggaatgttcaacactttcagttgaatgcaaagatcacaaagaagtttcttagaatgcttctgtttacattttatgtgaagatatttcctttttcaccttaggcattgagcgctccaaatgtccacttgcagattctatgagaagtgattttcaaaactgctctatcataagaaaggttcaactctgtgagttgaatgcacaaatcacaaagtagtttcagagaatgctgctttctagtttttatgtgaagttattcccatttccaccgaaggcctcaaagtgatccaaatatccatttgcagattgtacaaaaagagtgtttcaaaacagctctatcaaaagaatttttcaactctgtcagttaaatgcaagcatcaaaaagtagttcctgagaatgcttctgtctactttttatatgaagatatttccttttctactaaaggcctcaaatcactcaaaatatccacttgcagattctacaaaaagagtgtttcaaaacttctctatcaaaaggaattttcaactctgtgagttaaatgcacacatcacaaagaagtttctgagaatgcttttatgtgaagttattcccgtttccaatgaaggcatcaaagccatccaaatatccacttgcagattctataaaaagagtgtttcaaaacttcactatcaaaaggaagattcaactctctgagttgaatgcacacatcacaaagaagtttctcagaatgcttctgtctagtttttatatgaagatattcccgtttccaccataggtctcaaagtgctccaaatatgcatttgtaaattctacaaaaagagtgtttcaaactgctccatcaaagggaaggttcaactctgtgagatgaatgcacacatcacaaagaattttctgagaatgcttctgtctagtttttatgtgaagatattcaagtttccaaagaagaccacaaagccctccaaatatccacttgcagattctacaaaaacagtgtttcaaaactgctccatctaaaggagggttcaactttgtcagttgaaagcaagcgtcccaaagaagtttctgagaatgcttctgtgtagtttttatatgaagatctttccttttctaccataggcctcaaagcgctccaaatatccacttgcagattctacaaaggaatgtttcaaaacagctttatcaaaaggaaggttcaaccctgtgagttgaatgcacacatcacaaagaattttctgagaatgcttctgtccagtttttatgtgaatatattcccatttcccccaaaggcctcaaagcgctccaaatatccacttgcagattctacaaaaagagtgtttcaaaagtgctctatcaaaaggaaggttcatctcagtgagttgaatacacacatcacaaagaagtttctgggaatacttctgtctgctttttatgtgaagattttcccgtttccaccgaaggcctcaaagcactccaaataaccacttgcagattctacaaaaagagtgtttcaaaactgctctatgaaaaagaagtttcaactctctgagttgaatgcaagcatcacaaagtagtttctgagaatgcttctgtgtattttttatatgaagataattccttttccaccttaggccaaaaagcgctccaaatatccacttgcagattccacaaaaagtgtgtttcaaaacagctctattgaaaggaaggttcaactctgtgagttgaatgcacacatcacaaagaagtttctgagaatgcttctgtttcgttttcatgtgaagatactgctgtttccaccgaaggcctcaaagccatcaaaatatccacttgcagattctacaaaaagagtgtttcaaaccagctctatcaaaaagaaggttcaactctgtgagttgaatacacacatcacaaagaagtttctgaatatgcttctgtctagtttatatgggaagatattcccgtttccactgtaggcctcaaagtgttccaaatatccacttgcagattctacaaaaagagtatttcaaaactgctctatcaaaaggaagattccactgtgtgagttgaatgcacacatcacaaagaggtttcttagaatgcttctgtctagtttttatgtgaagatgttcccgtttccattgaaggccacaaagctctgtaaatatccacttgcagattctacaaaaagagtgtttcaaaactgctctatcaaaaggaagtttcacctctctgatttgaatgcacacatcacaaaggagtttctgagaatgcttctgactagcttttatctgaagatattcccatttccaccgaaggcctcaaagcgctccaaatatctactttcagattctacaaaaagagtgtctcaaaactgctctatcaaaaggaatgttccactctgtgagttgaatgcaagcatcacaaagtagtttcggagaatgcttctgtctattttttatatgaagatatttccttttctaccataggcctcacagcacttcaaatatccacttgcagatcctacaaaaagagtttttcaaaactgctctatcaaaaggaaggttcaactctctgagttgaatgcccacatcacaaagtagtttctgaggatgactctctcttgtttttatgtgaagatattccggtttccaccgtaggtctcaaagcgcaccaaatatccacttgcagattctacaaacagagcgtttgaaaactgctctatctaaaggaagtttcaactctggagttgaatgaacacataacaaagaagtttctgagaatgatcctgtctagtttttatgtgaagatattcccgtttccaacgaagtcctcaaagccctccaaatatccgcttgcagattctacaaaaggagtgtttcaaaactgctctatgaaaagcaaggttccactctgtgagttgaatgcaagcatcacaaaatagtttctgagaatgcttctatctagtttttatttgaatatattcagtttccaatgaaggcctcaaagcgctccaaatatccacttgctgatttacaaaaagagtgtttcagaactcctctatcactacgaaggttcaaatctgtgagttgaatgcacacatcacaaagaagtttctgagaatgcttctgactagtatttatgtgaagataatcccgtttccaccaaatgccataaagtgctccaaatatccacttgcagattctacaaaaagagtgtttcaaaactgctctctcaaaaggaatgttcaactctgtgagttgaatgcaagcatcacaatttagttactgagttactgaaaatgattctgtctagtttttatatgaagatatttccttttccagcataggcctcaaagcactccaaatatccaattgcagatcctacaaaaagagtttttcaaaacttctctatcaaaaggaaggttcaactctctgagttgaatgcacacataacaaagaagtttctgataatgtttccgtctagttcttatgtgaagatattcccgtttccaatgaaggcctccaagcactccaaatatccacttgcagattctagaaaaagtgtgtttcagaactgctctatcacaaggaatgttcaactcactgagttgaaagcacacatcgcaaagaagtttctgagaatgcttccattttttttttaagatatacccatttccaccaaacgccacaaagtgctccaaatatccccttgcagattctacaaaaagagtgtttcaaaactgctctctcaaaaaggatgtacaacactgtgagttgaatgcaagcatcacaaagtagtttctgaaaatgcttccatctagtttttatatgaagatatttccttttctaccttaggcctcaaagccttccatatatccacttacagattctacaaaaagagtgtttcaaaactgctctatcaaaagagatgttcaactttgtcagttgaaagcaagcgtcacaaagtagtttctgagaatgcttctgtgtagtttttatatgaagatatttccttttctaccataggcctcaaagtgctccaaatatccacttgcagatgctacaaaaagagtgtttcaaaacagctctatcaaaaggaaaattcaactctgtgagttgattgcacacatcacaaagaagtttctgaatacgcttctgtctagtttatatgggaagatattcccgtttccactgtagacctcaaagcatttgaaatatccacttgcagtttctacaaaaagagtgtttcaaaactgctctttcaaaaggaaggttcaactctgtgaggtgaatgcacacatcacaaagtagtttctgagaatgtttctgtctagtttttatgtgaatatactcccttttccactgaaggccaaaaattgctccaaacatccactttcagattctacaaaaagagtgtttcaaaactggtttatcaaaaggaaggtccaactcggtgagctgaatgcatacatcacaaagaagtttgtgagaatgcttctgtctatcttttttttgaagatatacctgtttccaccgaaggcctcaaagtgctgcaaatatccacttgcagattctacaaaaagagtgtttcaacactgctctctcaaaaggaatgttcaacactgtgagttgaatggaagcatcacaaagtagtttctgaaaatgcttctgtctagtttttatatgaagatattttcttttctaccttaggcttcaaagcgttccatatatccacttgcagattctacaaaaagagtgtttcaaaactgctctatcaaaaggaatgttcaactctgtgagttgaaagtaagcatcacaaagtggtttctgagaatgcttctgtgtagtttttatatgaatatatttccttttctaccttaggatcaaagtgctccaaatatccacttgcagattctacataaagactgtttgaaaactgctctattaaaaggaaggttgaactctgtgagttgaatgcacacacatcacaaagaagtttctgagaatgcttctctctagtttttgtgtgaaggtatttccatttccacggcaggcctcaaagcgctccatatatccacttgcagattctacaaaaagagtgtttcgaaactgcactatgggaaggaaagctcaattttgtgagttgaatgcacacatcacaaagatgtttctgagaatgcttttctctagtttttatatgaagatattaacttttgaaccatagacctcaaagcgctccaaatatccacttgcagatcctgcaaaaagagtgtttcagaactgctctatcaaaaggaaggttaaagtctgtgagttgaatgcacacattacaaagaagtttctgatagtgcttctgtctagtttttatgtgaagatattcccttttccgacaaagtcctcaaagtgctccaaatatccacttgcagctcctacaaaactgctctatgaaaaggaaggttcaactctgagttgaatacacacatcacaaataaatttctgagaatgcttctgtctagtttttaatgggaagatattcccgtttccaacgtatgcctcaaagctctccaaatatccacttgcagattctacaaaaagagtgtttcaaaactgttctatcaaaaggaaggttcaactctgtgagttgaatgcaagcatcacaaagttgtttctgagaatgtttctgtctagtttttatatgaagatattaccttttctaccaaaggcctcaaagcgttctaaatatccacttgcagattctgcaaaaagagtgtttcaaaactgctctataaagaggaagttaaaactctctgagttgaatgcaagtatcacaaagtagtttctgagaatgcttctgtctattttttatatgaagatatttccttttataccacagacctcaaagcgctccaaatattcacttgcagattctacaaaaagagtgtttcaaaactgctctatcaaaaggaaggttcaactgtctgagttgaatgcacacatcacaaaggagtttcagagaatgcttctgtctaatttttatgtgaagatattcctgcttccaacaaagtcctccaagcgctccaaatatccacttgcagattctagaaaaacagtgtttcaaaacagctctatcaaaaggaatgttcaactctgtgagttgaatgcaagcaacacaaagtaatttctgagaatgtttctgtctggtttttatatgaatatatttccttttctaccataggcctcaaaacgctccaaatatccacttgcagattctacaaaaagagtgtttcaaaactgttcaactcccagagtggaatgcacacatcacaaagaagtttctgagaatggttctgtctagtttatatgggaagatattcccgtttccaccatagacctcaaagcgctccaaatatccacttgcagattctacaaaaagagggtttcaaaactgctctatcaaaaggaaagttcaactctctcagttgaatgcacacatcaaaaagaagtttctgagaatgcttctgtctatttcttatgtgaagatattcccttttccaatgaaggcctcaaagtgctccaagtttccacttgcagattctccaaacagagtgtttcaaaactgctctatcaaaaggcctgttcaaatctgtgagttgaatgcacacatcacaaagtagtttctcagaatgcttctgtctactttttatgtaaagatattcccgtttgcaccgaaggcctcaatgcgctccaaatatccacttgcagattctacaaaaagagtgtttcaaaaccgctctatcaaagggaatgttcaactatgtgagttgaaagcaagcatcacaaagcagtttctgagaatgcttctgtctaatttttatgtgaagatattcccgtttccaacgaaggcgtccaagtgctccaaatatccactagcagattctacaaaaagagtgcttcaaaactgctcaatgaaaaggaaagttcaactctgtgagttgaatggacacatcacaaacatgtttctgagaatgcttctgtccagtttttatgtgaagatattcccgtttttatgtgaagatattcccgtttccagcaaaggcctcaaagcactccaaatatcctcttgcagattttacaaaaagagtgtttcaaaactgctccatcaaagggaaggttcaactctgtgagttgaatgcacacatcacaaaaaagttttggagaatgcttctgtttactttttatgtgaagatattcccgtttccaccgaaggcctcaaagctctccaaataaacacttgcagattctatataaagagtttttcatgactgctgtatcaaaaggaatgttcacctctgtaagttgaatgcaaacatcacaaaataatttctgagaatgcttgtgtctagtttttatatgaagatatttccttttataccatatgtctcaaagcactccaaatattcacttgccaattctacaaaaagagtgtttcaaaactgctctgtcaaaaggaaggttcaactctgtgagttgaaagcacccatctcaaagaagtttctgagaatgcttctgtctagttttcttatgaagatatttcattttctaccacaggcctcaaaacggtccaaatgtccacttgcagattctacaaaaagagtgtttcaaaacttctctgtcaaaagaaacgttcaagtctgtgagttgaatgcacacctcccaaagagatttctgagaatgcttctctctagtttttatgtgaagaaatttcctttttcaccataggcctcaacgtgctcaaaacgtccacttgaagattctacaaaaaaagtgcttcaaaactgctctaataaaagaaaggtacatctctgtgagttgaatgcacacatcaccaagtggtttctgagaaagcttctgtctactttttatgtgaagatatttactttttcaccacaggccttaaagtgctccaaatgtcctcttacagattctacaaaaacagtgtttcaaaactgctctatcaaaataaagtttcaactctgtgagttgaatgcacacatctcaaagaagtttctgagaatgcttctgtctagtttttatgtgaagatattcccttttccaacaaaggcctcaacccggtccaaatatccacttgcagattctacaaaaagagtgtttcaaaacttctctatgaaaaggaaggttcaactctgtgagttgaatgcacacaaacaaagaagtttctgagaatgcttctgtcttgtttttatgcgaagatacttccttttgcaccagaggcatcaaagggctccaaatgtcctcttgcagattctacaaagagagtgtttcaaaactgctttgtcaaaagaaagtttaaactctgtgagttgaatgcacacaccacaaagtagtttctgagaatgcttctgacttgttttcatgtgaagatatttcctttttcaccacaggcataaaagggttccaaatgtccgcttacagattctacaaagagagtgtttgaaaacagctctatcaaaagaaagattcaactctttgagttgaatgcacacatcacaaagaagtttctgagaatgctcctgtgtagtttttatgtgacgatatttcccttttcagccaatgccccaatgcggtctaaatttccacttgcagattctacaaaaagagtgattcaaaactgctctatcaatagaaaggttcaactctgcgagttgaatgcacacatcacaaagaactttctgagaatgcttctgcctactttttatgtgaagacattcacgtttccaccgaaggcctcaaagcggtgaaatatacaattgcagattctacaaaaagagtgttttgaaactgctctttcaaaaggaacattcaactctgtgagttgaatgcacacatcagaaagaaatttctgagaatgcttctgtctagtttttatgtcaagatattgccgtttccaacaaaggcctcaaagtcgtccaaatatccacttgcagattctacaaaaacagtgattccaaactgctcttccaaaagaaaggttcaactatgtgagttgaattcacacttgacaaagaagtttctgataatgcttctgtctagtttttaagtgaaatatcccgtttcaaacgaaggcctcaaagcactcctaatacccacttgcaaattctacaaaaagagtctttgaaaactgatctaagaaaatgaatgttgtactctgtgagttgaaagcaaacatcacaaagaagtttctgagaatgcttctgtctagtttttaagtgaagatatttactttttcaccacaggccttaaagtgctccaaatgtcctcttacagattctacaaagacagtgtttcaaaactgctctatcaaaataaagtttcaactctgtgagttgaatgcacacatctcaaagaagtttctgagaatgcttctgtctggtttttatgtgaagatattcccttttccaacaaaggcctcaaccctgtccaaatatccacttccagattctacaaaaagagtgtttcaaaactgctctatgaaaaggaatgttcaactctgtcagttgaatgcacacatcacaaagaagtttctgagaatgcttctatctagtttttaagtgaagataccccgtttccaatgaaggtctcaatgcgttccaaatatccacttgcaaattctacaaaaagagtgtttcaaaactactctaagaaaaggaattttcaactgtgtgagttcaaagcagacatcacaaagaagtttctgagaatgcttctgtcttgtttttatgtgaagatatttcccttttcaccatactcatcaaagggctcctaatgtccacttgcatattctacaaagagaatgtttcaaaactgctctttcaaaagaaaggttcaactctgagttgaatgcacacatcacaaagaagtttctgagaatgcttctgtcgtgtttttatgtgtatatatttcttttttcaccataggcctcaaagcgctgcaaatgtccaattgcagaatctacaaaaagagtttttcaaaactgctctatcaaaagaaagtttcacctctgcgagttgaatgcgcatatcacaaagattgagaatctcagtcacaggagagctgctgtgtatagatgtctgtggcagggggtcaaggtattcatgctgcagaagacaagctggaatctccctccacccctatttcgacccaaccaagggctctggttcctttcataaacctgcctctagtcttccccacctttctctgttcctatcccctctctaattgctggatgaggctgtgctgctgcagccaactgtctggcccctgagcattacatccccgtactccaggcctttattcatcaccaaaacagcatggtactggtataaaaataggcacatagaccagtggaacagaatagagaacccagaaatgaacccaaatacttacaaccaactgatctttgacaaagcaaacaaaaacataaagtagggagaggacaccctattcaacaaatggtgctgggatcattggcaagccacatgtaggagaatgaaactggactgtgtggcatagacaaactttcttattattattcaatgaaacactcacgtaggacctactgggaaggtattttgcagaggtaatgaaaggtcctgctcttgtaactagcaagtgtattcaggtaagcctgacttcatcagtgaaagtcccttaaagaaagacataggcattccttgaacaacatttaaaatagcgaatgggactgtaatcttccaattgccccctactgacttgggaccaaagctttgaatcatgatcactgggatccagccagctgaggatttttcttcctaactgactttaacagggatctcatacttgctcaggcatcccatcaactgtggaaaccagttccttgcacttaattcatatgtgaatctccctaagtatacat

SEQ ID NO: 790 - DNA, 5883 bp, Homo sapiens
tgcaagaaaatataataactaatataaatctgatgaatcaggtaaacaattaaatttacataaaaagtacacattcaaggggtgacggacggcacctggaaaattgggtcactcccacacgaatactgcgcttttctgacgggcttgaaaaacggcgcaccacgagactatatcccgcacctggctccgagggtcctacgcccacggagtctcgctgattgctagcacagcaggctgagatcaaactgcaaggcggcagcgaagctgggggaggggcgcccgccattgcccaggcttgcttaggtaaacaaagcagccgggtagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaatggttctcccagcacgcagctggagatctgagaacgggcagactgcctcctcaagtgggtccctgacccctgacacccgagcagcctaactgggaggcaccccccagcaggggcacactgacacctcacacagcagggtattccaacagacatgcagctgagggtcctgtctgttagaaggaaaactaacaaacagaaaggacatccacaccaaaaacccatctctacatcagcatcatcaaagaccaaatgtagataaaaccacaaagatggggaaaaaacagaacagaaaaactggaaactccaaaaagcagagcgcctctccttctccaaaggaacgcagttcctcaccagcaacggaacaaagctggtgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgcgatcaactggaagaaagggtatcagcaatggaagatgaaatgaattaaatgaagcgagaagggaagtttagagaaaaaagaataaaaagaaatgagcaaagcctccaagaaatatgggactatgtgaaaagaccaaatctacgtctgactggggtaccggaaagcgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaaccctacaagccagaagagagagggggccaatattcaacattcttaaagaaaagaattttcaacccagaatttcatatccagccaaactaagcttcataagtgaaggagaaataaaatactttacagataagcaaatgctgagagattttgtcaccaccaggcctgccctaaaagatctcctgaaggaagcactaaacatgaaaaggaacaaccggtaccagccgctgcaaaatcatgccaaaatgtaaagaccatccagactaggaagaaactgcatcaactaaccagcaaaagaatgagctaacatcataatgacaggatcaaattcacacataacaatattaactttaaatgtaaatggactgaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaacaacaaagatcaaaagagacaaagaaggccattacataatggtaaagggatcaattcaacaagaagagctaactatcctaaatatatatgcacccaatacaggagcaccaagattcataaagcaagtcctgagtggcctacaaagagacttagactcccacacattaataatgggagactttaacaccccactgtcaacattagacagatcaacgagacagaaagtcaacaaggatacccaggaattgaactcagctctgcaccaagcggacctaatagacatctccacctcaaatcaacggaatatacattttttttcagcaccacaccacacctattccaaaattgacaacatacttggaagtaaagctctcctcagcaaatgtaaaagaacagaaattataacaaactatctctcagaccacagtgaaatcaaactagaactcaggattaagaatctcactgaaaaccactcaactacatggaaactgaacaacctgctcctgaatgactactgggtacataacgaaatgaaggcagaaataaagatattctttgaaaccaacgagaacaaagacacaacataccagaatctctgggacgcattcaaagcagggtgtagagggaaatttatagcactaaatgcccacaagagaaagcagaaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaacgatcccacagaaatactaactaccatcagagaatactacaaacacctctatgcaaatcaactagaaaatctagaagaaatggataaattcctcgacacatacactctcccaagactaaaccaggaagaagttgaatctctgaatagaccaataacaggagctgaaattgtgggaataatcaatagcttaccaaccaaaaagagtccaggccagatggattcacagccgaattctaccagaggtacaaggaggaactggtaccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaccgaatccagcagcacatcaaaaagcttatccaccatgatcaagtgggtttcatccctgggatgcaaggctggttcaatatacgcaaatcaataaatgtaatccagcatataaacagaatcaaagacaaaaaccatatgattatctcaatagatgcagaaaaggcctttgacaaaattcaacaacccttcatgctaaaaactctcaataaattaggtattgatgggacgtttttcaaaataataagagctatctatgacaaacccacagccaatatcatactgaatgggcaaaaactgaaagcattccctttgaaaactggcacaagacagggatgccctctctcaccactcctattcaacatagtgttggaagttctggccagggcaatcaggctggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatactcaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgcttatgggtaggaagaatcaatattgtgaaaatggccatactacccaaggtaatttacagattcaatgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgacaaactgagaaaaacaagcaatggggaaaggattccctatttaataaatggtgctgggaaaactggctagccatatgtagaaagctgaaactggatccctcccatacaccttatacaaaaatcaattcaagatggattaaagacttaaatgttagacctaaaaccataaaaaccctagaagaaaacctaggctttaccattcaggacataggcatgggcaaggacttcatgtctaaaacaccaaaagcaatggcaacaaaagacaaaattgacaaatgggatctaattaaactaaagagcttctgcacagcaaaagaaactaccatcagagggaacaggcaacctacaaaatgggagaaaattttcgcaacctactcatctgacaaagggctaatatccagaatctacaatgaactcaaacaaatttacaagaaaaaaacaaacaacgccatcaaaaagtgggtgaaggacatgaacagacacttctcaaaagaagacatttatgcagccaaacaacatatgaaaaaatgctcatcatcactggccatcagagaaatgcaaatcaaaaccactatgagataccatctcacaccagttagaatggcaatcattaaaaagtcaggaaacaacaggtgctggagaggatgtgcagaaataggagcacttttacactgttggtgggactgtaaactagttcaaccattgtggaagtcagtgtggcgattcctcagggatctagaactggaagtaccatttgacgcagtcatcccattactgggtaaaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaagtcatcattctcagtaaactatcgcaagaacaaaaaactgaacaccgcatattctcactcataggtgggaattgaacaatgaaatcacatggacacaggaaggggaatatcacactctggggactgttgtgggctagggggaggggggaggtgggagggacagcattgggagatatacctaatgctagacaacgagttagtgggtgcagcgcaccagcatggcacatgtatacatatgtaactaacctgcacaatgtgcacatgtaccctaaaactttaattaaaaaaaaaaaagtacacattcaatgaattaaaaactaagcaaaatcaccaagtgataagagc

SEQ ID NO: 791 - DNA, 7160 bp, Homo sapiens
ctgcaaattttgagaatgtggtaacaataaacacctaaatgaaagaaaagactagaaattagaaaagttgggcttggcacagtggctcacacctgtaatcccagcactttgagaggctgaggcaggcagatcacaaggtcaagggtccgagaccagcctggccaatatggtgaaacaccgtctctactaaaaaatacaaaaattatcccggcacggtggcgggagcctatagtcccagctactcaggaggctgaggcaggaattgtttgaaccagggaggcggaggctgcagtgagccgagatcgcgccaaggcactccagcctgggcaacaaagcgagactccatctgaaaagaaaaaagaaagaaagaaagaaaaattggaatgcaatagagatagttgcataacaaagagactaaaatattgtctttataagagagggtttcagaaatattgttagtttctaaagaaagaagatgagaaaatcacattcaatacaataattagcagtttcttaatgcttttacaagttaattttcttttgggttaaataaaataaaaatattaggaactttgttttatacaaatgcattgaacaatatgcaagaaaatataataactaatataaatctgatgaatcaggtaaacaattaaatttacataaaaagtacacattcaaggggtgacggacggcacctggaaaattgggtcactcccacacgaatactgcgcttttctgacgggcttgaaaaacggcgcaccacgagactatatcccgcacctggctccgagggtcctacgcccacggagtctcgctgattgctagcacagcaggctgagatcaaactgcaaggcggcagcgaagctgggggaggggcgcccgccattgcccaggcttgcttaggtaaacaaagcagccgggtagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaatggttctcccagcacgcagctggagatctgagaacgggcagactgcctcctcaagtgggtccctgacccctgacacccgagcagcctaactgggaggcaccccccagcaggggcacactgacacctcacacagcagggtattccaacagacatgcagctgagggtcctgtctgttagaaggaaaactaacaaacagaaaggacatccacaccaaaaacccatctctacatcagcatcatcaaagaccaaatgtagataaaaccacaaagatggggaaaaaacagaacagaaaaactggaaactccaaaaagcagagcgcctctccttctccaaaggaacgcagttcctcaccagcaacggaacaaagctggtgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgcgatcaactggaagaaagggtatcagcaatggaagatgaaatgaattaaatgaagcgagaagggaagtttagagaaaaaagaataaaaagaaatgagcaaagcctccaagaaatatgggactatgtgaaaagaccaaatctacgtctgactggggtaccggaaagcgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaaccctacaagccagaagagagagggggccaatattcaacattcttaaagaaaagaattttcaacccagaatttcatatccagccaaactaagcttcataagtgaaggagaaataaaatactttacagataagcaaatgctgagagattttgtcaccaccaggcctgccctaaaagatctcctgaaggaagcactaaacatgaaaaggaacaaccggtaccagccgctgcaaaatcatgccaaaatgtaaagaccatccagactaggaagaaactgcatcaactaaccagcaaaagaatgagctaacatcataatgacaggatcaaattcacacataacaatattaactttaaatgtaaatggactgaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaacaacaaagatcaaaagagacaaagaaggccattacataatggtaaagggatcaattcaacaagaagagctaactatcctaaatatatatgcacccaatacaggagcaccaagattcataaagcaagtcctgagtggcctacaaagagacttagactcccacacattaataatgggagactttaacaccccactgtcaacattagacagatcaacgagacagaaagtcaacaaggatacccaggaattgaactcagctctgcaccaagcggacctaatagacatctccacctcaaatcaacggaatatacattttttttcagcaccacaccacacctattccaaaattgacaacatacttggaagtaaagctctcctcagcaaatgtaaaagaacagaaattataacaaactatctctcagaccacagtgaaatcaaactagaactcaggattaagaatctcactgaaaaccactcaactacatggaaactgaacaacctgctcctgaatgactactgggtacataacgaaatgaaggcagaaataaagatattctttgaaaccaacgagaacaaagacacaacataccagaatctctgggacgcattcaaagcagggtgtagagggaaatttatagcactaaatgcccacaagagaaagcagaaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaacgatcccacagaaatactaactaccatcagagaatactacaaacacctctatgcaaatcaactagaaaatctagaagaaatggataaattcctcgacacatacactctcccaagactaaaccaggaagaagttgaatctctgaatagaccaataacaggagctgaaattgtgggaataatcaatagcttaccaaccaaaaagagtccaggccagatggattcacagccgaattctaccagaggtacaaggaggaactggtaccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaccgaatccagcagcacatcaaaaagcttatccaccatgatcaagtgggtttcatccctgggatgcaaggctggttcaatatacgcaaatcaataaatgtaatccagcatataaacagaatcaaagacaaaaaccatatgattatctcaatagatgcagaaaaggcctttgacaaaattcaacaacccttcatgctaaaaactctcaataaattaggtattgatgggacgtttttcaaaataataagagctatctatgacaaacccacagccaatatcatactgaatgggcaaaaactgaaagcattccctttgaaaactggcacaagacagggatgccctctctcaccactcctattcaacatagtgttggaagttctggccagggcaatcaggctggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatactcaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgcttatgggtaggaagaatcaatattgtgaaaatggccatactacccaaggtaatttacagattcaatgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgacaaactgagaaaaacaagcaatggggaaaggattccctatttaataaatggtgctgggaaaactggctagccatatgtagaaagctgaaactggatccctcccatacaccttatacaaaaatcaattcaagatggattaaagacttaaatgttagacctaaaaccataaaaaccctagaagaaaacctaggctttaccattcaggacataggcatgggcaaggacttcatgtctaaaacaccaaaagcaatggcaacaaaagacaaaattgacaaatgggatctaattaaactaaagagcttctgcacagcaaaagaaactaccatcagagggaacaggcaacctacaaaatgggagaaaattttcgcaacctactcatctgacaaagggctaatatccagaatctacaatgaactcaaacaaatttacaagaaaaaaacaaacaacgccatcaaaaagtgggtgaaggacatgaacagacacttctcaaaagaagacatttatgcagccaaacaacatatgaaaaaatgctcatcatcactggccatcagagaaatgcaaatcaaaaccactatgagataccatctcacaccagttagaatggcaatcattaaaaagtcaggaaacaacaggtgctggagaggatgtgcagaaataggagcacttttacactgttggtgggactgtaaactagttcaaccattgtggaagtcagtgtggcgattcctcagggatctagaactggaagtaccatttgacgcagtcatcccattactgggtaaaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaagtcatcattctcagtaaactatcgcaagaacaaaaaactgaacaccgcatattctcactcataggtgggaattgaacaatgaaatcacatggacacaggaaggggaatatcacactctggggactgttgtgggctagggggaggggggaggtgggagggacagcattgggagatatacctaatgctagacaacgagttagtgggtgcagcgcaccagcatggcacatgtatacatatgtaactaacctgcacaatgtgcacatgtaccctaaaactttaattaaaaaaaaaaaagtacacattcaatgaattaaaaactaagcaaaatcaccaagtgataagagctcttgattttaaaatatttgtagactttgtgagtttagacataagagacttgaattagagggtagggagcatagctcaaaacacgtctaaagctccgaatctcaaaataactggatttcatctcccaaacattgtttctaagttctacatcaaaagaaatataagcatttacttgtacaatattttagtcccatatgtaattccattaaatcataccagtacaggggaggcagagataatacagcggtcagctggtatggaaaccataggtgagctgcttagtggacagggctccagggcccggtaaccactgtggtccagtaaggtgagagaataatctgtaggtgcatagacaacaccaaattattcatgaacatctatctggccaaattcacccaaatgaaccattgagggaaataagatggtggagttgggcaacattttgtgacaggccatagtgtctgctgtgcccacatcccagatgatgtgaacatcgccacttctatcaggtgcaaattcactgacaaggtcaagagcaagagccatggggaatttccctccataaaagtgtctgtctccttaccaagtcacagccccaactcagcttctttcagagttctaccaaggcaacttcctgtttatctccacattattaatgcctacatttaatacaaata

SEQ ID NO: 792 - DNA, 13943 bp, Homo sapiens
aacatttacagtaggaactacatgctttttttcaaaattttcagtgctgttttagacagtaataaatgaagttttataatgtaaactatattcccccttattggaatcctgaggtgcacatgtattatttctctaatcatcctctgttaatgctgcctttggcaataaaaggtggagatacacatattctctgctgtatcaaatggactggaatgatagaggttctcaaaagcaaacggcatgtggtacaaattttgccattctcaaagggaacaagaaaagtcagaataataaaaggcaaaatggtgacaacatagaacaaaaggacaagatcaaggggaactgattctgctttaaattacctaccatttgtagtggatatatttcatcaaatccagctgcctatatctgtaacaatgttgataaaaataagaatgcttctatcatatttggcacttctgtgtttaggtgagaaagctgtgactttgacatttttataattcatgaaatttaccacatttttccaattaagaatagcccaggagagaggaaaggtagaaaatgatgaagaaaaatatcagtgcatatgttccctttacaaatatgccatgacctctttagtaatattgcgagaagtgccagagatgcaaaaacaaaaaagaagacacaagatgatctcataagagaaatgataagacaagtttattaaatcacacataacaccatctgtagaaacaacaaaatctcttcatgaaaaacactaataaaaatttgaagtccttcaattgttttacatcattactgcttctaattagaatatatttctcctctgaattttaatcagagctttcctcagtgcaactttgacatccttgttcctcaaactgtagatgaggggattgagcatgggcaccacattagtgtagaaaacagaagaaacttttccctgctccatagatccagaagaatatttaatatacatgaatgccgctgacccaaaaaacagagacagagcaatgacatgagagctacaagtactgaaggcttttgatcttccttgagtggatttgatatgaagaatgctagtgacaatgaaaacataagaaatgaggatggtacaactgggtaccgtgatattagtacccacaacaatgagaacaaccacctcgttgacataggtgctggtgcaggaaagctggaggagggggagtatgtcacacaagtaatggttgatgatattagcactgcagaaggtgagtctaagcatgcacccggtgtgggccgtggctccagccaatcccattatgtaagcagcaaaagtgagcatagaacagacctgatgggacatggtgaccttatacagcaatggattacagatggccacatagcgatcatatgccattgaagtcaacatgtaacattcagagatgacgaaaaagagaaagaaaaacagccgagtcatgcacccaacattggagataatattcttttttgacacaaagttcattagcattttgggagtgaaaacagaggagtaacagagatcaatgaaggagagattgaagaggaaatagtacattggtgtgtggaggtgagaatttagaccgaaaagagtgatcaagccaaggttgcctaccatggtgacaatgtagatcactagaaacaggaaaaagaggggttgccggaactctggatgatctgttaatccagcaagaataaattcagtcactaaggagttgtttctagccagcattttttgtcttcaaaaatctgggaagacaaaagaaaattctattaggaacacagatttctttttacaaaatctcattaatgaggaggggactcaggctgtaggaatttgggtgagttctttgtttcatgggatctgaatgtactgaatgtactgccactcccactcctcaacatttcagtcagtgtcttttgtctgtacagactgaatgtgacaaacaattgctcctgtccttactagaagacacagaggtggagtagctgaggcacaggcctacctgctgttgagcttgggttatatggatgtgtctcatctccctcacttccatctgtcccttcacttcctagtttctacttatgtttccattattctactagacacttcaatttccctgtgatgaccaccaggtaagggaggattcctttagggcggagaccatactgatattctgtttcctagacaggggtctcctatagggtttctagataccttactataagaatccatgaagtcaccgggtgataaaagaagacccttagtagtcgaggccttatgattcaccacatacaaatcacataagtgtttctacacattctcctctattccatcctagctagacagaggatgaagaaaggaagctgaatgtgctttcacaggtctttgtaggaaggcataagggaaacataattaatttgggtacagttatattagttgttaagtttgtaaaattttaccaaactggtatttttatgacccttaaactcttctatatgtatagcacatgtcaatatatttttaataaagagacaaatctcctttcctggcattcctctgttctggatgtgtcacttggaactgctattgctatcctgataccaggctgagaatgaagccaacagagagaacagtgtgagaaaaatgcaagcccgagagtcagagctccataccactaagtttcttgctattgaataaatacttttccccatttttcagcaacatccaggagagagaaatagaaacttgattaactcaccttccttccactcagagaactcagtgctgaccattgatatgtgtttcacctccactgccctggaggtagaactggtggtgaaggtatctacgttgaccacatgtagtcaaagaatcttcttctcccttacctggcaaaagcattgagcatagatctcagaatctgaatgttctgggaatcattctgaggtgtagatcaaactatttataaatttgccaagagggtttgttagaaaatcagacttcacaccagacccaccatgtccaccgtcatagagacatggcatttgctcaaggctcataattcttagacctgattacataccaacagtaagtctctctcaggacctcccctaccatgacacactctgcagggaagaaattatatgcctgtgtttacagcctaacttgttgttgtagatgtaaacttttcatcagggattatacaatccacagggcataggagaaagagcctctgctgtcatgtataaagatgtaaacataaagattgtcagaatttttgctaattataattatcggcagtgttagctttaacaagtatgtatgtataatttagtaaagtttattgctatgctcatttttaatattgtgagtccttttaaataatccatttttagttttgcatactttataggcaaaaagaaaagaaaaagaataaagaaaaggatacttttaattgatttcagattttttaaataaaattttgtgtaacatagaatgatcctttatttcatcaaaatttaattatcttgggttgctctaactcaacatgtctttgcctttaacaggttaaaatcaaatctgtaagaaaaatcactaatcatgtgccctcattttaagacagtatgacttcagaatttcccggtaggtaggaatttgtgcttgtgagaaggcatctatattttttacctttttattttaaaattattagaatcacaagaagtggcaaaagtatatgtagattcccttggacacttcacccagcttcctcacacagagacatcttccacaactgtaggacaatagcaaaatcaggaaactgacataggttcaataatgttaaagaaactacagaccttattcagcaatttaacatgcgtgtgtgtgtgtgtgtgtgtgtgtgtgtgtgtctgtgtgtgtgtgtagatctatgcagttgaatcctatgtacctatttatgtaacaaaaacctaagtcaggatacagaattctttcttttttttctttttctctctctctcttttttttttttttaaagacagggtcctactctgtcacccaggcatgagtgcagtggtgcaatcacagctcactgcagcctcaacctccaggactcaatagatcgtcccacctcagcctcccaagtagctggcactacaggcacatgccaccacacctggctaattttttaattttttgtagggatagggggtctcactatgttacccaggctggtcttgaactcctggtctcaagaaaccctcctgcctcagcctcccaaaagtgttgggattacaggcatgaaccaccatgcctggcctctaattaattcttaaacagacttttaagcattccatttgttctgccccatcctcacttcttccagaaatatctgctgtcgtgaaattgtgagaatgttggagactgtgtgtaaatcaggtgtgttcttggttttcccagttctatcatagggtcagatgttgtaagaatgccagtgcagatactgcttgtttatctactgtctaatttccaaaatctgggagttgttctaattctaccttttttttttgtccctgggagcgaacaccatttttatttttatatatttatttatttttttcccttctgatttgcttcatttttttattttattattattatactttaagtttcagggtacgtgtgcacaatgtgcaggttagttacatatgtatacatgtgccatgttggtgtgctgcacccattaactcctcatttagcattaggtatatctcctaaagctatccctcccccctccccccaccccacaacagtccccagagcgtgatgttccccttcctgtgtccatgtgttctcattgttcaattcccacctatgagtgagaatacgtggtgtttggttttttgttcttgcgatagtttactgagaatgatgatttccaatttcatccatgtccctacaaaggacatgaactcatcattttttatggctgcgtagtattccatggtgtacacgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctaggtcagatggtatttctagttctagatccctgaggaatggccacactgacttccacaagggttgaactagtttacagtcccaccaacagtgtgaaagtgttcctatttctccacatcctctccagcacctgttgtttcctgactttttaatgattgccgttttaactggtgtgagatggtatctcattgtggttttgatttgcatttctctgatggccagtgatggtgagtattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcacatgagtaggttgcgaaaattttctcccatgttgtaggttgcctgttcactctgatggtagtttcttttcttgtgcagaagctctttagtttaattagatctcatttgtcaattttggcttttcttgccattgcttttggtgttttagacatgaagtccttgcccatgcctatgtcctgaatggtaatgcctaggttttcttctagggtttttatggttttaggtctcacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtacccgtaccatgctgttttggtgactgtagccttgtagtatagtttgaagtcaggtagcgtgatgcctccagctttgttcttttggcttagggttgacttggtgatgcgggctcttttttggttccatgtgaactttaaagtagttttttccaattctgtgaagaaagtcgttggtagcttgatggggatggcattgaatctataaatcaccttgggcagtatggccattttcacgatattgattcttcctacccatgagcatggaatgttcttccatttgtttgtatcctcttttatttcattgagcagtggtttgtagttctccttgaagaggtccttcacatcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttgctgaagttgtttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactgtgttgaataggagtggtgagagatggcatccctgtcttgtgccagttttcaaagggaatgcttccagtttttgtccattcagtatgatattggccgtgggtttgttttaaatcccttttctatcacattagtgactttgggcaaagaatacagacaatgcattgacattaagactgccatctttaaccagagtcctccagttgcatttctagaacaatgcctaggagcacaccaagcttacaggagcccggagattggcatttcaagctcccaggacttgaccagatgtattctgctcagagttgatgatgcatgaggcctaaaatcccataaattatctttattttagagattctactgatttatttcatcaaatgaccttcttttttgcatttaggttataattactgtgaacacagaaagtaggccctgcccataggattcctcagtctaatcagaaatataacccaggaaattaaaattgaaacttgtacctcctttagttattgtttgccaatcagagtgtgaaattcttttttttttttttttttgagatggagtctcgctctgtctccaggctggagtgcagtggagtgatctcggctcactgcaactccacctcctgggttcaagtgattcttctccctcagcctcccaagtagctgggattacaggtgcgtgccgccacgcctggctaattttagtatttttagtagagacggggtttcaccgtgttggacaggatggtctcaatctcttgacctcatgatccgcctgcctcggcctcccaaggtgctgggattataggtataagccactacgcccagcctaaattctttatctaccttctctcatatcacccttatgatcaccctctgaaccagacacccctatctcacatataagaaatccaaaactaagagggataatcaattgtttcaaagtcaaaatgcatactggtggagcaagttttatacttggtatctatgaatggaaaattgctttatttaatgactacactatgcagaattgtgttatacaatgtagaatgtgctactatgcaatctttacaaagtacattggggttctttccatttaagtgataggaataagacagcttacaccaaaaatgtgtgtaaaactggtaagtcaaggatgtggatgacttcttgtatgctggacaaagtagaatcaagtcatatcatgagtgagtgtgtctcttttcacttttctcctgcttaattctaccagggttttaatcttagatgggctctcacatgtagtttttgaaaaggagccccccagaactcctaggtttaattataacttcagggataaaaattgattgttaaaaatcattttggcagagaaaaactatagttacgttaatattccagactaatcaggaagttggacagctctgacacgagggtttgacatgtgctaactggacaagtttatagtctatgacatggacaagagagtccataaaaatcacatacagtgtgttccatgtatcagaaaagatcctgccaaaaaagccagtagtatgctatgcatttcctaaagaggatatttaaacagagaattagttatacagatattggaagggggaaagagcaaaacattggcacagagaaaatatgaagactaataaagtgtggaaaatagctaccactcccagaactcgtggaaaaatagaaaggggatgcataaccagattctcaaatgtcagagaagccctgtaggattggcgcttgaattaattgaggtatggaaataccccacagcttgtgcttggccctctcaagtagaggctccactcagagactgctgggactaacaaggaaggagaccaaccagaaggcctgataaatgcttgactgggacaaagtctaggtaatgtagtgaaagaggataggcacaaattccaggcaatgcaatgaggggggatggaacagctggtaagggagtgctatccagctattcactatacttctaagagattacaacaaattaagcacattggcaggtgtttattgatttgcatgtcttcctttaggacaggggtgtccaatcttttggcttccctaggccacattggaagaagaagaattatcttaggccacacataaaatacactagcaccaatgatagcggatcagcctttaaaaagtcaccaaaaaatagcaaaatgttttaagaaagtttacgaatttgtgttgggccatattcaaagccatccttggcttgagacccgaaagcttgctttcggatatgtcatttgaatcatttgtctgtttattaaatggtattttttgatatatattttaagtaatgagttgagatatatatgtggacacaatactttattgaatatatagttacaaatatttttctagcctgtgtttgcctatgagaacttttctgataaatagataatctcattttaattaagtttatttgtttttttttttcctttggggcttagtgctttatagaataatgctaagaaatctatgcctgcaccaacacaatttcatatgttttcttctagaagatccatagtttaagcttttttgtgaatggttttggtccatctttagattaagttttgtgtatagtgtgaggtagaggtcaaggtttggtgttttccttatggataggcagtacatccagcaacaattgcttcaaagccttttctttctcaatggaattactctgttccttggtcaacaatcaattgaccgcgtgagtgaggctctgtttctgaatctgctattctatctcatagacttgttcacctgtctttataactaaactaatctgtcttgattatcacagccttatgctaatttttaaaatcagctaataagatccaaaattgacaccctaacatcacaattaaaagaactagaaaagcaagagcaaacacattcaaaagctagcagaaggcaagaaataaatcagagcagaactgaaggaaatacagacaaaaaaaaaacccttctaaaaattaatgaatccaggagctggttttttgaaaggatcaataaaattgatagaccactagcaagactaataaagaaaaaaagagagaagaatcaaatagatgcaataaaaaatgataaaggggatatcaccaccaatcccacagaaatacaaactaccatcagagaatactacaaacacctctacgcaaataaactagaaaatctagaagaaatggataaattcctcgacgcatacactctcccaagactaaaccaggaagaagttgaatctctgaatagaccaataacaggatctgaaattgaggtaatcagtagcttaccaaccaaaaagagtccaggaccagatggattcacagccgaattctaccagaggtacaaggaggaactggtaccattccttctgaaattattccaatcaatagaaaaagagggaatcctccctaactcattttatgaggctagcatcatcctgataccaaagcctggcagagacacaaccaaaaaagagaattttagaccaatatccttgatgaacattgatggaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaagtctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtatgcaattaggaaaagaggaagtcaaattgtccctgtttgcagatgacatgattgtatatctagaaaaccccattgtctcagcccaaaatctccttaagctgataaacaacttcagcaaagtctcaggatacaaaatcaatgtacaaaaatcacaaacattcttatacaccaataacagacaaacagagagccaaatcatgagtgaactcccattcacaattgcttcaaagagaataaaatacctaggaatccaccttgcaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtgatttatagattcaatgccatccccatcaagctaccaatgactttcttcacagaattggaaaaaactactttaaagttcacatggaaccaaaaaagagcccgcatcaccaagtcaatcctaagccagaagaacaaagctggaggcatcacgctacctgacttcaaactatactacaaggctacagtcaccaaaacagcatggtacgggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttataccttatacaaaaattaattcaagatggattaaagacttaaacattagacctaaaaccccaaaaaccctagaagaaaacctaggcattaccattcaggacataggcatgggcaaggacttcatgtctaaaacaccaaaagcaatggcaagaaaagccaaaattgacaaatgggatctaattaaatgaaagagcttctgcacaacaaaagaaactaccatcagaatgaacaggcaacctacaaaatgggagaaaattttcacaaccctcatgtgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaacgttcatcatcactggccatcagagaaatgcaaatcaaaaccacaatgagataccatctcacaccagttaaaacggcaatcattaaaaagtcaggaaacaacaggtgctggagaggatgtggagaaatagttacactgttggtgggactgtaaactagttcaacccttgtggaagtcagtgtggccattcttcagggatctagaactagaaataccatttgacccagccatcccaatactgggtatatacccaaaggactataaatcatgctgctataaagacacatgcacacgtatgtttattgtggcactattcacaatagcaaagacttggaaccaacccaaatgtccaacaatgatagactggattaaaaaaatgtggcacatgtacaccatggaatactatgcagccataaaaaatgatgagttcatgtcctttgtagggacatggatgaaattggaaatcatcattctcagtaaactatcgcaagaacaaaaaaccaaacaccgcgtattctcactgatagatggcaattgaacaatgagaacacatggacacaagaaggagaacatcacactctggggactgttgtggggtggggggaggggggagggttagcacgagatatacttaatgctaaatgaggagttaatgggtgcagcacaccagcatgtcacatgtatacatatgtaactaacctacacattgtgcacatgtaccctgaaacttaaagtataataataataaaaataaataaataaataaataaataaataaataaaatcagctaatataagtctgctttgtcatttagggtccccttagaaggagatgtcaagaaatagacttgcaacacattttttgttataaatgcctattaaggataaaactgaaaggagcaagagtcagtgatgaaggcctcagaccaggatgaaggcctcagccgggatgaaaagagaaagaaatggaaagttcgggtaggaaaatctcagaccatagagcagttctaaaaagtcttggtcaggaggataggaagtctctaagcaaagatttcctatcagaaaagatacatgttagatggaaattggccagctctctttaagtcccacccaccctgctgagtcattggctcaggacatctcagagtaagaatgtactctgcctaaacaccatggtggatccaaggaagtgcaactatagactttcagtcagccatgcaccccaccgatgggtctcttcatggggagctgagctgttcttctctggggctaccacagtccacctccaaaaatataaattaaaccccaaatttgttcagatatataattgtcgttatttttatatgttattaattattacttaaagtaatacatttattgttggtgttaagcaagatactccagttcagccaggcacagtggctcacacctgtaatcccagcactttgggaggatgaagcaggaagattgtttgaggccaggagttaaatttttttctccaaatatttaaaaagtagggaggcatgatggtgtgtgcctgtactcccagctacacaggatgctgaagaagtcctctacctcatgctatacacaaaagttaatctaaaaatgaaccaaaaccatacaaaaaaaaaaagcttaaactataggctgatgtagaagaaccacttgagcccaggaggtggaagctgcaatgagctatgattgaaccactgcattcctgcctaggtgacagagtgagatcctgtctcaaaaaaaagacaaaaacaaaacaaaacaaaacaaaaaaacttcaattcaacaactatttcttgattttacaatatatctgacattttaaatacatgaacaggaaaagaattcgacaaaataaaggaattatgagaaataacctttatataaaatgtgtttcacgtcttgttggtgagatgataaagtttaagtaggctcacaaaatatttgtagaaatatagtttattaaaattaatatacattttttcatgacaaaccacattggataa

SEQ ID NO: 793 - DNA, 9541 bp, Homo sapiens
gacggaaaactttacttcgtgttccgccaccaaaaaaatatcgtttaaacaaacctgcggcagcttcccagctcccttaaaccaggatcccaagttctccgcgtctccgcccctgcacccagcctccggcctcggcaggcgcttccggtgcggaaccttctggaaagtaccgcgccgccctcccggcgtccccacaaccccgcccgcacctgcgcgcaccggcgctcgcgagcacaagtgacgggactggagcgtggcgcggcaggtggctccacgaaaacgccccttcgcgcaaggctgccccgcgtcctgccgcgccccaggaggcgggacttccgcccccgccgcccggaagcggcagccgggggaagcgtgttcctcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggtgcgcgcggggctgtttggggccggggtcgggatgggggtcagggcaggtgttaccgttgggatcgagatcgggaccaggtttaaggttgcgatcgggtcgggatctggggtcgccgtctgctttccccagcggaggagccgctttccggggccgctctgcgcggagggttccgggggcggctgacccttcccgccggcttctgtggccgagctccgtcgcgtcctcgcccttctccccgcccctgcgagtccgccctgggtgccatcgccggagcgcgggccggggcgaggctgaggtggaagccgggcctccttcaggggcgtttgcaggagcgcgcccgcgagctgcgtgcggttattgagcgtttgaaatatggctcgtgtgattcctgaagggaatgcttagtttacgtcaatttaaacttaacgcaagcagggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggtaggaggatcccttgagtccaggggtcccaggctgcacagtgtgagccgagatcccgccacttcactccagcctgagcaacagagcctgtctcaaaggaaaaaaaaaaaaagtagtgcaggtttttaacattagttatgtgttgaaatagtatttttagcatattgaattaaaagtatgatcgaaattcacctgtttctttttaatgttgctattagaaaatgtataatttcacatgttgctggcattctgtttctgtcggccaggactgctctagcggcaaggatggttttcccagtcctaactcctcattatactcagtactttgagaaagggggcacagaattatactactgtggttgcgttaggtactttatattagatttttatcttttgttaaccttatttcctctattattagcatcatacactaagcatggtgtatatatcaaaattaatgagccaaaataatatagattaattatagttattatattagtttataatacattactgttaactaaggttcatgtttcattgagatttcctcagcttttacctgctgttctgttctagggtcccacatgacaagtagtcttcatgcctccgtaggcatgttttggctgtgacaatttctcagacttgttttgatgatcatgagtgtttgaggcgtcctggtcaggggtttggtagaaggtccctcaattgagacttctctgaaggttttctcatgattagactggagttacattctttttccttcttttcttttttctttttccttgagacggagtttcgctcttgttgcccaggctggagtgcaatggtgcaatctcggctcactgcaacctccgcctcccgggttcaagcaattctcctgcctcagcctcccgagtagctgggattacaggcacgcgccattatgcccagctaattttgtatttttagtagagacggggtttctccatgtcggtcaggctggtcttgaactcccaaccttaggtgatcctcccacctcggcctcccaaagtgctgggattacaggcatgagccaccatgcccagcctgttatattcttttttaaaaatcagaattctgaaaaatcagaaattctgaatcaatattctgaatttcttaggtctttttaaggaaacagatttactctgccgttaaagaacttgaagtaggctgggtgcggtggctcacacctgtaatcccagcattttgagaggctgaggtgggcggatcacttgaggtcaggagttcgagaccagcctgaccaacacggtgacactctgtatttactaaaaatacaaaaaaattagccaggcatggtggcatgcacctgtagtcctagctacttgggaggctgaggcaggacaatcacttgagcccaggaggtggaggctgcagtgagcccagatcgtgccactgcactccagcctgggtgatagagtgaaactctgtctcaaaaaagaaaaaaaagaacttgaagtagaaccgggagctgagcccagcctttctcttttaagcaggtgttctgtatttgcttgtcatgtctggggagaagtgaattgggccttgtgggttgggaaagacttatacagacagaaggcatgagcaactacaggaaggtgctagaagacagcatgtttcttcttgagtctcacctgtccacacttgaaagttccagagcctcatctggtgaaatctccagcttcttcctggaggtctcatgcagtttacggcttcctgtctctgtgcctatagctcccaaatattttctctggctcagcctgactcccccatacctgccaatttgagtcttggcctggtttatgacaggcccccaggtcggcgtggcccaaacggagcccttgagtcaccaccgtgcccttccacagcttccttttccgccactgtctcagcgagtaaataccagcaggttcgacttttgctattcccagctctgccgcgttgaactttttttgttgctgttgagacagggtctcgctctgttgcccaggctggagtgcagtgcagtgcagtggcaagatcatggctccctcctaggctcaagcaattctcccacctcagcctcctgagtagccgggactacagctgtggaccaccttgcccggctaattttttaatgtttttgtagagacggggtccccctgtgttgcccaggctagtcttggactcctgggctccagtgatctgcccacctcggcctcccaaagtgctgggatccactctttttcagattccagcagctctggaacagaccttcataatgggaatgttttcttcctcactgagtgtttgtttatttatttattttctgaggcggagtctcactctgtcgcccagactggagtgcagtggcacgatctcggctctctgcaacctccgcctcccaggttcaagcgattctcctgcctcagcctcccaagtagctgggatcacaggcgtgtgccaccaagcccggctaatttttgtattttgagtagaggtgcaatttcaccatgttggccaggctagtgtcgaactcttgacctcagttgatctggccacctcagcctcccaaatgctgggattacacgtgtgagccactgcacccggcctgagggtctaaaatgtgcttagtatgactgaggacatgatgttttaattttatttaattttgcttaaattttgaattgaaacatcctcatagctagtggctgctgttgggcattgcagttctaggctctgctgaagcatcatggtcagggaggcccatcttggccccgtggacactttccgcctgcgccccgatagccgctgtcctctttcctagcctggcgttctccgtaaccacagttgcgtttggggtagtctgtctcctgctgttcactgtctgcctctcattagagaagaagatgcacagggctttgcttgtctgttttgctctccagcgcatcactcagaacagacctggcactagctttgtgggagggagagtggcggtatgctcagagaggcctccccagggctgtgccaagggccttgtcttctctccatgctcttcccaaatagtctgacaatttggaaataacatcttgtcagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtatgtggtgggttcagatcctctgtggaccctcgtggttatgtggccaggtgcatatctgctggcgccttggttatgtgactgggtgcaggtcctccgccgacccccttggtcagctttcttgaaagtgcttggggcactgggcctcctggggcccatgtccgagaccatcacccctgaatcacacattattaccagtaactgtcagctgaacttggacagaagacaagcttttcaaaatgtccttaccttggccgggcgcggtggctcacgcctgtaatcccagcactttgggaggccgaggcaggtggattacctgaggtcaggaattcgagaccagcctggccaacccggcaaaaccctgtctctactaaaagtacaaaaattagccaggtgcagtggtgggcgcctgtagtcccagctactcgggaagctgaggcaggagaatggtgtgaaccctggaggcggagcttgcagtgagctgagatcgcaccactgcactccagcctgggcgacagagcgagactccgtctcaaaaaaaaaaaaaatgtccttaccttggccaggcacggtggctcacgcctgtaatcccaacactttgggaggccgaggcaggtggatcacctgaggtcaggagttcgagaccagcctggccaacagggcgaaacctcgtcactactaaaagtacaaaaattagccgggtgcagtggcaggcacctgtaatcccagctactaaggaggctgagacaggagaattgcttgaccctgggaggtggaggttgcagtgagccaagattgcaccactgcactctagcctaggtaacagagtgagactccgtctcaaaaaaaaaaagcccttaacttttagcaaatgttggacagatcttgtttgcatgagaccaaatgcagtgcatatcccagcagtgattttatacctgcttgatgccttggaaagcggcgtggcttgtgccctcggctgctcacctggacctgctgccaaagacgcttctctgcggcctgtggcactcacaggcctgatgcctggcgtctgcttgtttgtttgttttgagacatagtcctgctctgttacccaggctggagtgcagtgacgtgatcttggcccgctgcaacctttgcctcctgggttcaagcaattctcctgcctcaggctcccaagtagctgggactacaggcacacgctgccactcccagctatttttttgtatttttagtagagacggggtttcaccgtgttagccaggatggtctctatctcctgaccttgtgatccacccgcctcggcctcccaaagtactgggattacaggcgtgagccaccacacccagcctaatttttttttttttttgtatttttagtagagatggggtttcaccatattggccaggctggtctcaaactcctgacctcgtaatccgcccgccttggcctcccaaagtgctagggtgacaggtgtgagccaccgcgcccggcctggcctctgcctcttaatgccctgttgaacaggcgggactgagcaacaggatcccgcctgtccccactggcagatgctgcatagacagcgtccaggagggtccttccaccttgtccttgtgtccctgtgcaggtggatctgtagaagaaatgcctgcctagagaaggaaatgcagggtgggctaaggtagagtttacattttgaaaagttcttcgaatgggatagtgcctgttcatgcacatactaaaagttcagatagtaaaaatgtgcagggctgtcctccacagacgccgccccccagtccccagagctgtcctggctgcttgtgcacaaagaaagtggagtgacagatgcaggtgtggctgcatccagtggcttcggccttcctgaggcgttttcacctggatgcaaaagctcacaagagaaaaggcatctgcactggtgtccggcccccacatagcagcttggggtgtttaggtcccgctgtgttggcctccgccatggcgcgtggttgggggcctgtgaggctcaggttttggacacagttgagtgagggtgacaaggggggacccagaaaccacccctgggccccaccaagcgccagccaccatccggtttgcttgctgctccattggtggaatcagatgcatgttttttcctgtatgggggtgaagacagttgagtgccggcccctctggcccaagcctcgggcgggcaggagccatcggctgagcttgctgagcttgctgcctgatcaggggtcgtgtttgcgggcggaggagggggtgtttgcgggcggaggagggggtgtttgagggtggaggagggcgtgtttgcgggcggaggagggggtgtttgagggtggaggagggggtgcaggtgcggcactcaggtgcctttcaccttccaggtcgggagcaggctgaactcactgggctccgcctggcaagcttggggttgaagtttaataaaatcgtccattcgtctatgacgcgcgccatagagaccaccgatatcatcagccggcacctgccaggtgagtgctgcgcgcggggcctccatgcttgcagcagtgggcggctcgtggcagggccccggcctgagctcctggccaccgggaggtcacagcatctccgccggcggggccgcctcacccagcgcttcgctgtgcttctctgcaggcgtctgcaaagtcagcacagatctgctgcgggaaggcgcccccatcgagccagacccgcccgtgtctcattggaagccggaagctgtggtaaaaacctccccggggggcagctgtgtcaccctcgccttccctgggcaaagcggccctgctgggctcaccatccaccacgtgcccggccgtcccacgggcttccccgggcggcgatggggtctgtcctcctgacacccgccctgcccgagcacttccgcactgacggctcctcactctgcccccagcagtattacgaagacggagcccggatcgaggccgccttccggaactacatccaccgcgcagatgccaggcaggaggaggacagttacgagatcttcatctgtcacgccaacgtcatccgctacatcgtgtgcaggtaggcagctgctgggctgggcgtggtctaaaataatttcagacttagagaaaagcatgaggaagaagccgagcgagaccctcctccactgccgatgccaccctagtcaggcctcaccagcccccgggcgtccacttcccgcgagtcctagtcagttacgcggtaggtggcgtgttacttggagcttctcataaggctgttttgggcaagggtggtgcagacagggagggacccctgtggtgtcctgggtggggtgcgtgctgggtggggggtcctgagtggggtgcgtgctgggtgggggtgtcctgggtggggtgtgtgctgggtggggggtcctgggtggggtgcgtgctgggtgggggtgtcctgggtggggtgcgtgctgggtgggggtgtcctgggtggggtgcgtgctgggtgggggtgtcctgggtggggtgcgtgctgggtggggggtcctgggtggggtgcgtgctgggtgggggtgtcctgggtggggtgcgtgctgggtggggggtcctgggtacggtgcatgctgggcgtccgcactgccctggttgttttccctttgtaattgaacgtcctgtttcccctcaaactcgaccaaccaccttctgcctccggctggatcccactggcagcatcccgccgctgttgtccgctggggattttgtgcttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaaatttgcctcttctctggatccattaggaaatgtgtgtgtgggctccgcagctgagggggccctcttgagtgtgacgagtcctgtggtgggaggacaggacggcactggtcagtgatgccgtgtgaggctgggccctggtctctgcccgtctgtcacctgggcctgtcaccagggctggggctgctgggagcaccatggtcaagagcagcagctcccagaaagtcgaggatgtacgggccgagattctcaagcttggctccagaccagatagagcttttctgggggttggagcctccgggtggtgtggcctcaggctaagtgagtacctgtttgctgtgagtcgttcgttgcctcctgtctgtgcttgtgaatgagccatatgggtggcttctatgctgccaccaccaccttgtgtgtccatgacacagtcaccccgaggtgacacaaatgctaaaaatgcacagaaataaccggggcgggagagtggagccgacctgagtccacacagtggtgagggccaggcacgtgcacctggacacgagaatatggctgtgctgttccggccggtgccgccaggcagccctgaggaggctcgggaagcagcgtgagggtggccatgcggcccactgagacagggcggtgggtggctcagaggcgatgaaggcaactccgagcttttccgcaaatgcgaattgtgcctaagaagtgcatgaagatgccacggcgggtagatcccatctccgttctttgctttcccagaaagggacctgttgcactaactggctgctccctgcttttatatgggaaaagcaga

SEQ ID NO: 794 - DNA, 108137 bp, Homo sapiens
gcaatcagatatcccatgcagaaatatggacttggatctacagcatgcacattgtataaaaattaactcaaatggataaaacctaaaacttcaccaaagaggacagacaccaggacagcaaagaagcccattaaaaaatgccccacagccaggcgtggtggctcacgcctgtaatcccagcactttgggaggccgaagcaggtggatcacttgaggtcaggagttcgagaccagcctggccaacatggtgaaactccgtctccactaaaaatacaaaaaattgggggggcgtggtggcaggcacctgtaatcccagctaaccaggaggcagaggttgcagtgagctgagatcgcgccactgcaccccagcctgggcaatgagagtgaatctccatctccaaaaaaaagctccacatcattagtcgccagggaaatgcaaatcagaaacacaatgcgataccactacacacctactggaatagctgcaatttaaaaacccaatgataccaagtcctggtgaggatgtggaacagcaactcttgccacacactgctgaggagaccctgacacggtgcagccacttcagaaaagagtttggcagtttcttatcaagttaaacaaacacttaaaaaatgacctcagagaattgaaatttatgttcacacaaaaacctacacctacagaatgtttacagcagctttgttattaatcaccccaaagtgaaagcaacgcaaatgtccttccaccagtgaatgaaaagcaagctgtggtttgcccacacaatggacactgctcgcaacagaaagggagttctgatacacacgagcgcgtggatgaaccaattccaggtgtgttttgctaagaagccacatccaaaaggctgcacaatgtctctacttatgtgacgctctagaagagaaaaaaaatgcagggacggaagacacaccagtggctaaagggtgtcaggtgaggagggcagtgcggggaatgttttcgggcggtgactatcctgtatcctgctgatgatgatgcaattccattcacctaggaaaaatcacagaactgcacgccacagagtacattttactgtatataaattacaccttaataaaaatgaatttaaaatatgtaaaagtcaataaaggaattaaaatggtgagctaaaaacacttcttcaccacaaccagaccttgaggctgtcacctgatctccagcgtaaccttagccgtgtgtgagatgcagtttgctgggaaggctgagtgaggaaatggacagtgaagcactctgctctgtaagggctgacacccgcggtcgttatctggtaatattatccctccttggactcagcctgcctttcccagaaaggcctcagcatccgagcaagctctcatctcatcagctctgggtcctggtccagcctactggtctccggtgacccatcctcccagccggtggcactgggtgttcggctgtgccttcaccaacacaccaagctcaccccccagggcctttgcgtcttccctcctcctgcacctggtcccagcgcccctcacaggctccatccccacagcacctgcgcctctgaacggccctctcccttctcgggtcggctggcagcagacaggccccacaaggcaggacctttcctgtcttgctcacacctgagcacagatgccgcaactgtggctgcatgtgacagggacatgataaatgttggtggaatgaacaagtaacttacacctgctcctcaccttgcacacgctggcaccctgaccctacacatgtaggtacctcccccttgcacagctgaaagcctcatcctgcattcattaacatccttaccatgcacaggtatgtcggtgtccttatcttgcacacatacgctagcacgttcatggtgcacgcattacagcctcaccttgcacacagtaacattctcgccttacacatgtacgttagtgtcctctcctcacacgcacgctggcactctcaccttgcacacgtatttgatgaactccagggcagggttattgagcagcaagtgggaaccggggaggacaggaaacatctctgagagctcagtggagttccgagagcctgtgactttcttctgaatcttctgagtgatggtgaagaagctctgagtgagctcatttgcgacataatcctgagagaaggtgatcattcctggaagtataaggatgctgagggaggggtctgggacctgtctggcactggggacctcccacctgggggactggcaccggggaccacccatggcacacagaggagttaggtcactggcacatggcagtggcctcaaaagacaaaagactgctcaccgggaagggctccgaccgccccctcggcctcctgggagagctggctggcccccctcctcctcacgggggtgctccctggagcactgcgcctcagcccgtccttcatgcagtggtacacggccacgatgtacgctgtggagaggcacacacaccacaggccctgagtcgggctgctgcaaacaccctagaatctgaggggacccatggctggtcagattgcctcacagatgaggctaaaatgtcattgttaataattttatctgcagcctttagatgagctaaaagtaaattagagaagtgagaagtggaaatgagaaggaacactcgctgacacctgagttcattgtcagagagaaaactgtataaatggggccatgtacactaagcctctcactgggtagcgcgtgaaagacagctcccaacacaagcaaaggcagggcccctggcatcagcaagcttctccaaaaactactccgggcctgtcacctggcacttacccttttttttttttttttttgagacacagtttcattcttgttgcccagactgtagtgcaatggcgcaatctcagctcactgcaacctccgcctcctgggttcaagtgattctcctgcctcagcttcctgagtagctggtattaaaggtgtgcgcaccacacctggctactttttgtatttttagtagagatggggtttcaccatgttggccaggctggtctcaaactcttgacctcacgtgatccacccgcctcagccccctaaagtgctgggattacaggcatgagccactgcgcccggccaacccggaacttttcaaaagagacatagaaagttgcaagagagaactgagaaagttaaagactcaaggacaagtagacaaaaatataaaatgatcatcaacgaaggcctctgtgaccgcatccacctgtgtgtgcacatcacaacctgctgtttttacttagggcattctttaacttagggctgtcaactacaaacagtgcttcctcgatacacttcatctgcacactaacctgcatagcttgatttgcaaactctaagcctgcagacccaaaccaaggcataggaactcccccaccagaaagttaggcctcacagaccagccagggggcagctgacctgacccagggctttatcttcagctactgaacgtgcacacacacaaatgttccctgggaatgtatgtgactgagttaccgaatcagatggcgggagcagagctaggaaactcctcaatgacacggccaggggcagccgctccccatggagtttcctgagagcaaaggctggagggaagacagtcacccctctccgggccctccagtggaacatgcctggagcctggagaggaggcccctcggctcacaaagtcccaactgctgggcaggctccgcccgatctgattttccctgtctcccttcttgcgataccatggcacaggagccacatctactaaccatgagtcccttcagtgggggctgcgcagccctgggctctgggcttacctgaaacaatcatgaggaagtagttctggcaggaggctgcctgtggcaaaaactgcaaaatgttccagttgttttccagtaaatcctccacgttggattcctccgcctcttcctcctcctccccatctctttcctcctcatcgtcctcattttcctgctcatcctctgctccccctgctttctgggagtcttgctgtaacacatgagacaacgcggctgtgtttgcaccatcgcggcctggtagaggggtaggatgccacagcgaaggctcctccaacctgggtccatctgccccgtttgaccagaggccttcctcgcagtcaaggcatcccctggagcctgcgtgaatcccccagggtggctcccagtacaaagtgctttgtgggaagcgcctggcacacagaagtgctcgtgacctgggactgtgagcttcactctgctcttccagagttcactttaattgttgaactcccaccccccaaggacgaaagaaccagccagagcttcccggtgactgttctctcctctgagtccatgaatctcctgggacggcacgaccccatcacagacccagcctcccgcgcagcctgtgttcgtgccacggcaccatccacgtctgtgtagacaccgacacccactgccacctgccctgaccacacgctgatcccctcctcagagcggtctacactgcctgagtttctaccctcccactttgttctgaatcccttcaatcagggtttatcccccaactccaaccagaatcgctcccatccaggtgtcctgggcagtcttggcttcatcctgccagctcccagaagcgtctgcgtccttacaaagggctttccctctgacatctgagcccctggctctggtacccacagcttcctctcagtccactatgagggcccctgtggaggacacaggcctcctctcaacccacccagccactctctggccactcctgcaccagctgaccacccacgtctcaaccttgcaaacaccatgagccccagccagacgtgaccccttccccagactgctcccgacagccacctccactcacccacagcctggcccgcacctgggcatttacacacatccgatccgctggccccttggctccacttcaaagcccacccaggcccttctcaccaacctcgctgcccagcatctccctgacacaggcactaaccggctttacctgcctgtgccctccaatggtgggttatccacatggggccaagaaagctccaacatcacccacacagaagctcccatccccacgaaagccgaggccctgccctgccatgcccaagttgcctggctctgtcagctctctgcctgcatctgcaaccactgctccactgacttgtgctttgcctccctggtgtccatccgctggaggcgccttatgctcgcacaactatggtgcacttcatcagctctcggattccctgtcaccacctcatgggcctccacctccctgttgcccacggcaagccttgccatcaccagggctgacgccacactccacactgacgtgcttgtctgcgcatggtccctccccgtgttcatgagggcaggatgcgggtgcagtgtctgctgctcacggccaggcccgccggggccctgagcactcagcacttgctgcaggaatgaacgcgacccccaaagctggctcgggtgccacactgcagctcgcttaccagtccacagtgaatacgagatgaaacttttcctttgattccgccatagttagatggatccatccagagaagaaattcccagcatcgagagaaagaaattgtcagagaatggaaggtctcctttgaatggatgctgcagaggaagcattgaagacgctgcttcagtgaaatcgaccttgttctcaactttcctttatttccccttgtatctatctgtaccctccacttacttaacactgaatttgaaagttcattcagaccacatcatccctcaggcttcctggggaaatgtggtaaacgtaaaactaaggaggcccaccaggcccctgggagctggcgccacaaagagagctgggtgcctcctcgtgctggggatggcccacagggtgttctgcctctgctctgcggccttaggtgacctgcacctgctggtaaccaaccacagtgcttcccactgccaagctcttttaagctatcgtcatccttgtcactcctcggttaagcctccctagcgctgacccaatcctctgcacattagatccatttaaggaaaaaaaaaaaaaaaaaaaaaaaaaaagaacaggccaggcacggtggctcacgcctgtaatcctagcactttgggaggctgaggcaggaggatcgcctgagttcaggagttcaagaccaccccaggcaacgtggcaaaaccctgtctctacaaaaaatacaaaaattggctgggcatgctggcatgcacctctagtcccatctactcagtgggctgaggtgggcagatagcttgagcccagagtttgaggccgcagtgagccatgactgcaccactgcactccagcctgggtgacagagcaagaccccatctcctaaaaaacaaacaaaaccccaaaaaatggaagaataaacaaagaaagagaggaaggaaggaggaacatcctaaatcacagtttcaaaatgcagctgagtagcccacatcgcagctcctgcaggagaactttatgttctccctaactctgctcttcgcgctaaggaagaatagcagcctgtttctcgacatgagcaaccccggcctcctcaggtacagggcacccctggagctgcccatggccaacgtggggagaggcacatccttcccattatctcagccatgctccgaaatacaattctagcccaagccagctttcccaggcacacagcgtgaccactgaccatcaaggctcatcttggatagacataaggggccacagtgggtctgcaggaggacaacagtgcttttgtgtttcaaattaatccagtgcatatggtttgattaggaatgaaagtcttataagctctaccttcctacttctcagtgataaggcctattatcaatttagtgtcagccttttctgcagcgcccccagatgctacccctgtaaccatgcaaagatcagacccatgcagactctctgtgcctccacaagcaactcccctctgtgctcagaaagggctgcattcatccccagggtgagcgcacctaggagggagcttcctactatcagttgaacaaaagttgctggtggagatttttctgttgctttgtcttctatttagatttaaatagtgctgagtgtgtgagaagcacagcaaggcctaggagggaacctcaggaacatggcctggaaggcaggaagtcaaaaccacaccaggctctgacagctgagagctgtgcacacctgagcacccgggaaccacaccactccactcgccaacactgacgtctatgaaaaggcttacaacgtcaacacttacggggtgcatatattcagggcaccttgaatctgtgccctgaatatccatggggaaaaaaagcaaacaaacaaaaatcactgtggaaccttcttagcaaaggcaggccacttcctgaacttgcccaactcaagctgcacagctgagtggcctccgatctgctaccgcgcacaggtggcggtaacccccttttcacgctgctcagattcaccatggtgagtcctgcacttctaacgacctcccagcccacccaggaggagagctggcacctcagggggtcattttagcatccctctcaaagccacagtgctgcgtcaccaggaccagccagccgcacctgctggtgatgtactccacgtaagcgatggcatcttccacacggcgcttctttgtacagaggatgatgcggttgaagttggcgtagatgactgatgaccccaggcgcttgaactcagcgatgagcctgtggagcaagttgagagtccgtggtggagacgccacagtcatggagagccagagggcacccagaaaatccaagagggaaaagagctgagggtcctgaagcagaaaagcctccgagatacactagaacccagaagctaatgaagagcaaagatttctgcatggcaaaaatccaccacaaacaaaggcaaaagataaccaaaaacaggaaaaaattagcaaattcttatcacagaaaaatggcaactttttgtatggagacaactcattcgatatttaataagagaagaaccaccaaaactacagaaaaatagacaaaggactagaagagaaaattcgacttcattcattgtaagaatcctaagttaagactgcaccaagaagcacttttatcccagcagttgggtaataatccccggccatgttggtgaggcgcggccagggaagaagtgtccacaaggggcctctgtggggccgctctggtgaagtccatcaaatcaggattcatcccgagttacaacacctctgaggcctgcaagagggctacgccccagcaattaccccacggatctatctgcatgagctcatgcatgaagcctctcactgatttgctatttgtaacaacggcacaaggctggagagaggctaaatgttctttcatatggcatgtcctcacacagatctcctgacacaggcatattttcactaaaacaacaaggcacacagcaatacaatgtgtagcatgactttgtgcaggaaaggggcaggagaggaggtgccacctagtgttctctgcaggatgtgcaggcgacgctgcagcagcagctgcgtgtttctctgggatcctttggattgttatgctccacaaactcagaaatacactacttatcccagaggcactggctggccatgtctctggttctggggagtaagggaccagcccagctgaggacgcggtggacagcccagggaggaggagcactcactgcaggaagagcttcttcatcatgttgtggagtgtgcggtgcagggcagggtcatgaagcagagaggatggcgaccgaagccagcggtagaagtgcatcacctggttgtctgcatagatgttgtggtactgggtgatctccttcacccagcccacgaccatgctcttcaggatcctgaaagagaaggtgcacgacaccctcgtaccctcagcctcccacgctgctgccacgcgggacgctccaactgaaatgggcacaggttttccctacacggctgggtccaaatccgtcactgtcgcctccccttctcactgtccccaccttaagtcacggtccaaatttcatcccttcaccctcatgcctcatctgtttcttcccatttcattccttaaacttgttcaggcttcaccgcatcccaaactctgtgtgttctaaagcaggacgggagggcagcacagtacaaagcagcaagtgtgtgacgggccggggaccctgacaggaaggacacagcaaagccactgcctagacatcagaacaccacactaggccggatgcagaggctcacgcctgtaatcccaccactttgggaggccgaggcaggtggatcacctgaggtcaagagtttgagaccaacctggccaacatggtgaaaccccgtctctattaaaaatacaaaaattagctgggctagtgcatgcctgtaatcctgctactcgggaggctaaggcaggagaatcgcttgaacccgggaggtggaggttgcagtgacccaagatggtgccactgcattccagcctgggtgacagagtgagactgtctcaaaaaacaaaaacaaaacaaaacaaaacaaaacaaaacaaaacaaaacaaaacatcaccatacccacatggccccagctggtcagaaacaagaacttagaggcctctctcccgcctagcaggctgggccctgccttcccgccacttcctttaaatggaccattcaggcgctcgcccgtgaactaacacatgcctacaccccattccctcacacgcctagctgccctgggcaccctccctgtctgactcttcagtcctgccttgcaggacccagggatggaggatggcctccctactcacggcaccctccctgcccaggagctgtaaggaacacatctttgcacttgttccctattgtggtggtgactgattttgtgccttccctctgaagaggcaggggctgccctgggctgggtcttccctacgacactagggggaacacaaggctgggcccctacaccgaagcaatggtcaggcaggtggtacctagacacaggtcacacaaaagccacaagggcgtgtgccagtgtaaacaagtttcccgttccggggggccctggtcacaggccagacagctaggcattggccagtgcactgtacacgccctgtctggcccccttcacttcccatggggcagagatgccagctgctctggtactggaaccccaattcagctaaaggattccaaaactgcacatcaccctactgaagaagcgggaacttcaatggggtcaagaacagaatgttacaagagaacctacagaggtccaagtcccattcctaaaactccctttcatcacaaactcttcaataatttggcaaaccccacattctccagagcggcagtttgggtatctgctgttggactccttctacctttcaggcctgggctactgtctctctgccaagaccctgctcccggctcccaactgcctccctgcctctttccaccagtcctctccctgcctcatttcccagctctggcatgctccctctccccttttgtatggagtcattaaaactacagctgagtacaggctctggaattacaaagacttgtttttgagcacctacccttccattcatttgtggtatgaccacaaaggcagcccctctgacctcagtttccttatctgaaaaacagacaataaccgctccccgtccctgggctgatgtggggacagaggcagaatgcgaagtgctcggcccacctcctggtacacagcaagcattgcccagcatgaaccaccgctggtgggtaatgcgagtagctgccctcaaccatgctctccgcagactgatggctcctgaccctcaaccacgccctctgcagcagaccgacggctcctgacacctaagtgctgatgcctcacacatcatactcagtagagctggctggagatccctgtgatgtacctttggtcacatcgaaaagtggccctggttagaaagactctgtgtgaagtacctctggccacagggaggtcagaggcagcacactgaacagtcgccagggaccaggccggacccccacagtggtaaagacaatagactatggaaaactcgccacacagtggtctctggctctgccattaagactaagggaagcccaatggaccctgtcttagaccttagctttccaaattaagggcaaaggataagacccttctattagtaacactccttcccagagagggtggcacctgaaggtgttagagcacagggctgtctcatcgtagctggccggggcactggcagcctgaccacccgtgatcatgtcctccagggaggcctgctggatcacgtcgaagctgatccccatgctgtcggccccctccatgtcgttgacatggtgagactggagaatggtgttgacggccaggttctgaaggtccagctccacacacactgcacaggaagacgccatgctcagccagcatcctgccagctccagcaccaccagccccctgggcctgactccagccaccaccacctccagaaccagcaacagacctgcccacacccatcctcacacctgccaggctattcagattcccgagggcacaggaggccccacctggaccttgaccccaggaccgtctcctgcagcctcagctctgacctgcgcggtcgaactctgagcccatcctcggcactattgccttgagaagatgtcacagaatggcagaaacaccagccaggtctcatgggcctcgtcctcccgcccacttacctgtggagtaacagcctgaactgttgatctcaacagtggcttggtcatcgaactccatgacaagacagttgtcatcagcctcctttccacccaggtcagggcgggctgtaggggacagccagagcaggtggttgtggcgctggaggtggcgggcaaagaagaggtcggagccgaatgtggagatgtcctctggtaggttcccaatgggaatgtgaaagtacctgcaccagggcacaggtcagcaccggggcacatcgccgggtcacagagaccaccgaggccggctctgcctggggaccactggcccacaacgacagtactgtgctcacctgctcatctcgaaggcctgcgacaggcaggtgtccaggttgaggtagtgacggatcatgcgccgggctccatggcgctgccagtccaggaccccatagttgatcttgtcagccacacagataggcaccagtgggaattcctccaagacaggaatttcactggccagcctcttcagctcccagctggactgaacagcgatgagtgtgggcccccggcgctcctcctgggtcaaggcaaaatggaagaaaagacctgggtggacccagcctcaaagaagatggggctcacacagcaagaccccaaccactctcaccttgtaggcgagcaggaatcgctggatggctctgcagatggtcttcaggtcagtttctgcccgaacttcgaaggtgtgtttggggggtggcaggagctcagggcccaccttctccaggaggaggccgtgctctgctgagtacagggcgccaaggctgggcatctggttgctgcgcacctagaccaacgcaggccacgtcagcctccccctgcgcaggaggaagtgggggcagccctggggcagactccaccactgccacggcactgccaattcaatcacgacaagcactcatgggcaaaggcccttgaggacaagacctggagggcctgggcaccctgggagatgtcctccttccccaaaccctgccccagccaatgtgctgccatggagggcccaggactcacagtgtccagcacaaagacggatgccctgcgctgtgaggggatgaagatcccgaagagcgctttgtgggcctgtgcgtggtggtacaggtagatatggcggatactccctggagaaggaaacaagaccgtcaccccagatgtgtgggaggcaggcacatgatgggcggctggtgcaggccatacctggttccaggtagctgaactgggccagagagcgcatctccaggtgctcaagagcaaaggtctctgcttcccagcctgaaaggtgcctcaccagctgtttattgaccacacacacacagcccaggtgcaccagggcccggaacagtaacggaacctggaagaatcgggcagacaggccggcaagggctggatggtgggggctctggctgcccacgtgacttctgcccgggatgtggctgtgcccctgcagctgcccggcccactgcccaaaggccacttttggcagacacactgctgacattcacctcacctgtgggaacgagtccactgtcgctgctgttccccagcccacaccctgggcgggtttctttcctccataccaccctgctggagcctcccccagttcagtcgagggtggctggggagtcacctgagtctcatatacgccctcgatgtctggcgctgacagctcagcgttgatctcgttgatgtgttcctggtacatgtcctctggcactgaatactcatagagattgtagaccatgttggagcgaggaaggacccgatttacctggcgagaatacgacgatgatctcgtcactgggcgtaagtggtaatgtctgtggtacacacacaaagcacacgctattcggagtcctagacttctggtgcccctagcgacggggtacacccaccacgccacagtccacctctctcaatgattacaactaaaaactctggatgtaatttttatgttatttatttattttttacagacagggtcttagtctgttgcccaggctggagtgcagcagtgtgatcacagctcactgcagcctccaactcctgggctcaagtggtcctccagcctcagcctcctgagtagctgggacaaggaacacaccaccacggatggctttttttttttttttttttttttgtagaaaggaggtctcactatgaggcccaggctggtctcaaactcctggactcaagtgatcctcccaaatcgctggaactgcaggtgtgagccactatgcctggcctctggacgcaattttgaaaagcaacctgcagcctctgagaatagacaagagctgtcagaatacagcagtcaacactgatctggggaggttcccagttcatcttcctccattctctcatgggtttaacctgagggtgtagatggcaaaaactgagagaaatcacattttcctagtcagagaaacggaaagagagcccctgggggagccagagtgtgtgtgtggggtcctggggggctctgggagagctggagaggggcaccctagcttcgtgaatggggtcctggaggggtctgggagagctggagagggggcaccctagctccctgtgtggggtcctgggggggtctgggagagctggagaggggcaccctagctccctgtgtggggtcctgggggggtctgggagagctggagagggggcaccctagctccctgtgtggggtcctgggggggtctgggagagctggagaggggcaccctagcttcctgtgtggggtcctgggggggtctgggagagctggagaggggcaccctagcttcgtgaatggggtcctgggggggcctgggaaagctggagagggggcaccctagcttcctgtgtggggtcctgggggggtctgggagagctggagaggggcaccctagctccctgtgtggggtcctgggggggtctgggagagctggagagggggcaccctagcttcctgtgtggggtcctggggggtctgggagagctggagagggtgcaccctagcttcctgtgtggggtcctggggggtctgggagagctgaagagggggcaccctagctccctgtgtggagggctgggggaattctggagaggcgagctggagaggggtaccctagctccctgtgtggagggctgggggaatcctggagaggagagctggagagggggcaccctagcttcgtgtgtggggggctgggggaatcctggagaggagcaccctagcttcatgcatgaaccagcagcacaagtcccaggctcactacgagctgcacttgcacaggtgacccaaaacaacgcagcagaggctctggaggctgagctgacattggaagctttgcacaaagaggcaaggaagagcttgggcactggaattaaccgtgttggttgttgctaaaacaaacaaacaaaaaaacctgacacgctaaaggatttttaaaaatacccaaagtctcaaatatgtaaaatgtccaggttgcaataaagcgttatttggcgtaacaacaaccaggaaaatctgaataattctcaagcgagaagagaaccagtagggttagatttttccagtaacatgaaattagaccgacacacacacacacccacacacacacacacaaaatcaaagaaatgaaaaattatgttctggtaaatatgaactggaacaattagtgtaattgcactttttaaaatgtatatatttcctggctgttcactgaaggaatctagatgaaatgataccccttgagctctaagcttggtttctcaacataacctctcaacgaggctcaggctctttagaggaacagctaattccacgtctggaagttcaaggtgagcctggcctctcttagtggccaaaaagcaaggaagttttcaaagaccaacagggcatgtcaaaaggactcaggtgccagcttgaagggatctggccagcccaatttgggataatttgagtctcaagaagatattgaccaccaaagagtctactgtctggttccattaatatgaagttctagaaagtcacatgcacacagttacagaaatacagaaatcaggccagcagaaggttgcacagggggacaagagcaccctcccgggtgatggaaacgttctgcacctgggtgggggtgtgggtgacacaggcatagtcatgtgtccaaaaacccaatcaactgcacatttaaaaatctgcacttaactatatgtaaattacagtaagtcctcacttaacatcaatggattcctggaaactgtgatggttaagtgaagtaatgtatagcaggtcctcaaataacatcattttgttcaacattctttcttcctttaaaaaaaaaaaaaaaaaaattctggggccgggcgccatggttcaacctgtaatcccagcactttgggaggccgaggtggatggattacctgaggtcaggagttcgagaccagcctaaccaacacagagaaaccccatctctactaaaaaatacaaaattagccgggcgtggtggtgcgtgcctgtaatcccagctacttgggaggctgaggcaggagaatttcttgaacccgggaggcggaggttgcggtgagccgagatgcgccactggactccagccgggcaacaggagagaaactccatctcaaaacaaacaaacaaacaaataaaaataaataaatttaaaaaatactctgtagagaaggggttttgccacgttgcccaggctggtctcgaatgcctgagctcaagcaatccaccagcctcagcctcccaaattgctgggattacagatatgcagcactgcgcctggccaacacagtttcattatagtttctgagaagaaaaaaaatctgtttcattatacatcatcttacttagtcatttcacttaaaattgcagtttctaaggacctatcaacaacataaagtgagggcctaccgtgtaccttaacatacctaacgtgtgtgtgttgggcgggatttggctacggttgatgttaaaacattaaacactgaggcaggaggattgcttgagcccaagagtacaaggctgcagtgaggcaagatcatgccactgcactccagcctgggtgatggagtgagagaccttctcaaaaacagaaacaaaaaagttaaacaaaaatcctctaatccatagtaatactttaaaaagagaggaaaaatgaaaggaataaacccattttgccatgccctaccttgaaaattaaaaataatttaaagggaaaaagcatttatcttgcttaaaaaaaaaaaaagcgtattatccctctcgtatcttgctttttaaggaatagagttcatttctacctgatctgcacaaagctcttcgttataaaggaaacagctaatacacacagaggaacagaatctgaagatatcatcctggagccccatggaccccacgagacatggatgctgacaccatccagtcaaacgttgaggacagaatattcacacagcgccagaacctccctcgagatgagctgatagtcataaagggaaacatcccaaaagttagggcacttccacacggccacagcaccacagcaccacgcatcgaaaggaaggtgtagaaaccccacagtcccacctgttctctgtggtctcgatgcctctgcgtccgctttcctcttgttatccgcccacctcggtctcccaaagtgcggggattacaggtgtgaaccaccacacctggctctgcgtctactttctatatgcacattctactgaatcacctggctggaatcgagtttcaccttctccagaaaacctccttgtgtaggtacaaatatgcacacctcatctccccaactacgtgtcacttcttacgtgattcacagcatccagtcaagaaatgtgctgagccgacacattaacaacggggagttcgggtggagatgccatctaagagcctcagcgcactcatggccacatgaaaaccctcgcagtttctgcaggtggaagaagcccagcacaaagacccacctactgtagggttccatttacatcaaatgcccaaacaggcaaacccagagacaggaagtggatcagtggctactgagggctgggggaggatggtgacaggtaagggatgccaggtttctttttggagtgatgaaaatatccgaatgggggggtgaggggagggggaatatcaggataaacagctaatgcatgtggggcctaatgcccaggtgacggggtgatgggtgcagcaaaccaccatggcatgtgcttacttatgtaacaaacctgcactttctgcacatggatcccagaaatcaaagtaaaattaaaaaaaagaaaaaaaaagaaaatgtcactattgactggcaatagtcatgccactaaaagtcattgaattctgcactttaaatgggtgagttggatggcgtaactttacatcccaataaagctgttaacaaccaaagagcctacggagacagagttcacaatctctaaccaatgccacttggtttgtccccgcaacatggacctcgcgggcagacaagctcatcgtgacaaggacaccagcagctccattcccggcactcgctctgccccaggctcggtgctcagcgctcacacacgttgttttgaggaattcctagaacatccccataaggtactgaggagatggaggctggaggccaggctagatcatgggaaagccacctcaggctgcccagatgactgcagaggcagcaccagctcctccctaccttgcgatacgaagcaccctcctccgctttagcgactcgctggttcacgtagaacacacgggggatgctcagcctgatgcagtgcaagtcactgccaacgagcgcccacagcctgaacaggccggcctggctggtctcgctgatctgaaaggccacacggacatacagcacatcacaggacacactggaacccacagacggggccaccttccaggtagcttgcagctcccagcacagggccttaggcctccctacgatgggcaggaaactccaggcccactctaaccctcccatcccagacctcagggcccagctggacaccccctccctgggccatcagcagagccactgccctccccttggatcaaggtctatacctgcacaatctgccacggaaggtccaggatgctgcgggcagttcttcgcaagaagctccccagccccgtggcaggaccatcccggatggccccgggcctgagcacaccctctgccgactccagacgctgcctcttcctgcgggcgaggcgctgccgggcctgcagctgccacttcttcttgtggaaccggagccagacaagccattcctcctgggatggatggtgagcacagccagtgtgcaagtggtgagatgggaatgcccgccatgactttctcacaagcagcctccctaggggtcaggacgcatctcgggctccctgggctgtgcagacccctcagagacagacagtatcacagctgtgtgccttacctggctggttcccagggcgggaggctgccccaagatttcctgccagggcacagtcggcgtgaggtcctgggactcctcctggctctcccaaagaactcgcttcctcttcacagtgacaggggctgctgggtgaggcagctttacgaggccgaagtcctccatgtcaggagcacttggcctcggactgtcttctgaggcctcggccatcgtgacctggaaagacccagtgaagccttaaatctcaggatctcgggctgcgcagggtggctcatgcctggaatgccagcactttgggaggccaagacaggagaattgcttggggccaggagtttgagaccagcctgggtaacagcaagaccctgtctctacaaaatatattacaaattagccaggcgtggtagtgcgcctgtagtcccaagctacttggtaggctgaggcaggaggatcacttgaacccaggagttggaggctgcggcgaactatgatcacaccactgaactccagcctgggcaagtgagaccttgcctcataaaaacaagcaaacaaaaatctcaggatctcatccccacaaattctacttctcgaaatctagtataagtatatcacctgaaatgggatgttcgtttacacaagtttattgaacctttaatagtgaaggccgggtgtggtggctcacgcctgtcatcccagcactttgagaggctgaggtgggcggatcacttgagcccaggagtttgagactagcctggccaacatggtgaaactccgtctctacaaaaaatagaaaaattagctgggtgtggttgtgtgggcctgtggtcccagctacttgggaggctgaggtggaaggatcacttgagcctaggaggtaggggttgcagtgagccaaggttgcgccactgcattccagcctgggcgagagggtgagaccctctttcaaaaaaaaagtgaaaagatcaaaccgaaaaataaaacgtcactcaataccaccaataagtaaatctttgcattttgccatgtttgctccagaatgctttttgtaagaaagaaaatattgcaaataatgggtacagccctcttctgtctgcccccacacacctttaaatttttaccacatgtccacagacacatgccacagctgtaagttttaacctaaatagtaacatgtgggacacatctgactgcaacttgtttcctttttttttttttttttttttgagacagaatctcactctgttgtccaggctggagcgcaatggcacgatctcatctcactgcaacctcgcctcctgggttcaagcaattctgcctcagcctcccaagaagctaggattacaggcacctgccaccaagcccggctaattttttgttgtatttttagtaaagatggggtttcaccatgttggccaggctggtctcgaactcctgacctcaagtgatccacccacctcagccttccaaagtgttgagattacaggcgtgagccacatgcctgtccctgcaacttgtttctttattcagccatgtatttttgagactgacaccgggtgaaacatgcacatatggttcgttcattgtaactgatgtgaaatgatttatcatataaacacatcagcctacctacccatgactttgcaaatgaagaatgacaagcgcctactttttcaaaactacaaactgtgactcaatgaccatctctgtatgtgttgcctggtcccggagaacaaccacctccacctctagcaccagggatttcctacttcccacaatcttgctacttgatgccaccacacttacttgccttcagtgtgacctgctatctaaatacatcatgctgcatttacctcatcaacagtaaggctgaacatcttggccctgtgcaggcagctcccaaaatggcccaacgacccccacttcctggtgttcacaccctgtgtgactccttccctgagtgggggtgggacccggtgacttgcccgtaatgaacagattccagcaaaagtcatggaatgccactcctgagagcagctataaaacactgtggcttctgcctggctggcactctctcaaaagtccagtgccatgctgtgagctgtcctgtgaagagccccatggagcaggggactaaggataacgtccagacaaaggccaaggaggaaccgagtcctgccatccccatgggagggagctcggaagtggctccttctccagtggagccctcggatacacgagtgcatttaagttgctaagttttggggttacttgctatgcagcaatagatagctaacacgtttatgagccatttctaacttttatacattctaaacatcttcaaaatgtgactcaggcctttgtttcatggtgacttctgtgctacatgtaagtttgtgtgtgttgacttcctatcaggaaagttttcaaacatacacgaaagcacagtaatgagctcccatgttcttatcaccagtgtcaacaattatcaacattctgcctttcttgtcacagactacacaagatttaacttttaattaattgatcattctttccctttgtgatgtttttcacatgtgccttaaaaaagcccttcccaccccagcatcatagtctcctgagttgtttaccaaagattgtagtttcctttttttttttttttttttttttaaagacacaggggtctcgctctgtcacctaggctggagtgcagtggtcatcttggctcaccgcagcctcaacctcccaggctcaagtgatcctcccacctcagcctcccaagtagctgggactacaggcatgcacaaccatgcctaatgttgtgccggattttttttgtagagacgagacctccctatgttgcccaggctcgtctggaacttctgggctcaactgatcctccttccttggactcccaaagcactgcaattacaggcatgagccatcacactcagccttagtttcacactcagtgtgatacaacaacttacttctccaaatatgaaaaaccattttcaccagcatcactcactgcagtccactctctccttaacgatctgtgacctaccaacttccgactaacaggggagtctgtttctaggctcccaatcggctctactgctctcctctcatcttgtcaagatgccatgatagtgtgtctcgttacatagtaagatcaacgtgccctccttattcttcaaaattctttggttattcttatccttaccctttatatgaattttaggattcgtctgtcaagttctatccaaaaagcttttggcagattcttttttattggaattacactgaattttatgaattaatatggggcaaactgccatattttaatactgagtcctttcatctgtaaagatggtacctctttttgttacttaggtaaatttttatatgttcaataaagttgtgtataggccaggcatggtggctcacacctgtaatcccagtgctttggggggggcccaggcaggaggatcacttgagcccaagagtttaagatcagcctgggcaacagtgagacccagcctctacaaaaaatacatagccaggtgtggtggtgcacacttgcagtctcagctactcaggaggctgaggtgggaggataacgtgagattaagagttctaggctgtagggagccatgatcttgccaccgcactctagcctgggtgacaaaggaagaccatgtctcaaaaagaaaaaagttgtgtaattttttctgtaaaagtcttacacacattgttaccatgaatttattccttagtacattatttattgctattgtaaatggtatctttcaaaaaatattttgtttctagtataaatgaaagcaatagacttttatatcttaccttggtatctaattgttgctgaaatacatataagttaacacaaaatctaggtttccttacattttctgttaacaaattacatcgcctgtaaataataagttgatgtctcccttttcaatccttaattctttttctggtttaattatgctggctaggatctccaaactgttttgaacagaagcagtggttaacaggcatccatttcttactccttacttcaatgcttccagtgttttgtggttaagtatgaggtctgctgttaggtttcaagaacactttatcaggttaagaaacatctcatctattctgattttgattgttcaaactttaacatgagcagatgttaaagttttaccgcatgttgtttctgcatctattggagatgatcttacgagccttctcctttaatgatgaattagtggatttctcccaagaaaaactaacctggcaaattctaaaattaaacagtgcttgctattcccagcataagtcctagttggtcatattgttattgttcatgtatgttgatattttttcatctattgttcatggcccgtaactttcctttcctgttttcaattatgttaccaaagtaacaaggattgccaaggttaccaaatgagctaagggttttttttttcctttttctcttaaaaatcatttgggtttgatgtttcttttacacttattttttttcgtctcttttttttttctttttgtggagaacggggtctcgctatattgcccaggcaggtctcgaactcctgggctcaagctatcctcccgcctctgcctccctgagagctgggattacaggtgtgagccactgcgcctggcctgtttctttttaagtgtcaatttctgtaatggttaaagttctattcaggtttttattacttcttaggtcagtgcataacttgaggatactgtccgttccatctatgttttccaactgtttagcagaaaatgggaatccttccatttttttaggctttactatatctataatgatgtctgttttcattaaaataaaaaactctgtcctgaaaaagatgtgaccagccaggacaacatgacaaaaccttgtctctacaaaaaattacaaaaattagctggatgtggtggtgtgcgcctatagtcccagctatgcaggaggctgaggcaggtggatcaattgagcctgggaggtcaaggctgcagtgagccatgactgcgccactgtactccagcctgggtgacacaatgagaccctgtctcaaaagaaaagaaaaagatgtgactattttcctaagtcttttcaaagaacaacattttggttgtattgtttgtttcactcattctggctcaattttgtaacctctttcttttctttcttgagttgggttctccctgtgttgcccaggctggggtgaagtgcctattcacaggtgccatcatagcccactacaacctcaaattcctgggctcaagcaatcctcctgcctctcagccttccgagtagctaggactataggtgtgcaccaccatgcctggttacctttataactctttataacttctgtctacttcctctgatggatctgttgttctctaactttttcagttggaaacttaattttctatttgtttttctttactaatacatgcatttagatatataaatgcgtatacaagtcctgtttaactgcatactacaaattttaatagcatttgtatttacattcagttccaagtattgtctaagttctatgacttttttgatccacaagttataaatgtgttttttttttcttaaatttccaaacatggtctgtatttaagttatctagaattggttgcagcttactctgtggtatatatatggtcattattttatgtattcttgaaaaggataggtattctctaattttagtgcaagactacatttgttcactaaatgtattatagctagtgactaaatctagttagttgattgtgtcattccaaacatatttttgctgatttttggtctgctccaactatcaattgagggagggatgttaacatctcccaaactgattggaggtaaattcttcttataattaggtaaatgtttacattatttaatgtgaggctacattgttacaattagtatatatttccagagaattgtgactttcagtattatgtaacaatagtccttatgtttcctaatacttttggcctaaagagtattttgtctggtattaatacagccacatcagctttcttttggttaacatttacctggtatacgtattttttactccttttgcttttcctgcgtcctatcttttcaatataactcttgaaattgttatactggcccataagccactgggcgcagtgctgtatttccagcactttgcgaggccaaggcgggtgcattcacctgaggtcaggagtttgagaccagcctggccaacatggtgaaaccccgtctctactaaaaatttaaaaaaaaaattaaaaaaataaaaattagctaggcatggtggtgcgtgcctataatcccagctacactagaggctgaggcagaaaaaaattaaaaaaataaaaattagctaggcatggtggtgtgtgcctataatcccagctacactagaggctgaggcaggagaactgcttaaacccaggaggcagaagctgcagtgagccaaacccaggaggcagaagctgcattgtgccactgcactcctgcctgggcaatagagcaagactccgtcttggggggcaggggaaagaatacatatataactcttacaaataagacagttaaattttaaaatccaatccatctcagaacctttttctttttttttttttgagacggagtctcgctctgtcgcccaggggagtgcagtggcgtgatctcggctcactgcaagctccgcctcccgggttcacgctgttctcctgcctcagcctcccgagtagctaggactacaggcgcccaccactacgcctggctaattttttgtatttttagtagagatggggtttcactgtgttagccaggattgtctccatctcctgaccttgtggtctgcccacctaggcctcccaaagtgctgggattacaggtgtgagccaccgcacctggtcaaagaaccttgttcttgtcatgtgagtttgtatactgctctgatttatagcttacttttaattttcagcatttaagaattttccttttgctcttctgactttcactgtaccttttattacactgtgtcctgtgtttctaagtgtttccatagggaagatattcatttcacattcagaaaactggggcttcaagagacagtgatttgcccaaggcactgagtctaagtagtgcaccctaatattttcacataaggagacagttccttgccctcacctcagcctcacaatggtgtcctattaacaaaagagtgacactcagagttagagagtaaagtgccaatgggcacattttcagaaaaagtccattttcgatgcttgaacagaagcttcactacagcacacacagcagcgcaagaagcctggagtcctgtgtgtcacaaggatcccgcccagcccagccttggggccccaccgtcacctgtctcctgccctccagggtgaagagctcactgatcttcttctgcttgtagacatcattcttctccagcagttttttgtgcagccagtcggggtgtttgacacgtggcactgggttctttacctgtgtgaggccaacacccatcagagagagacccttgtctaactgcacagtttttagccccacagcccgtgccactgaccccgcccttacctgctgcagggccgcagggatggtgatgatcttctggatggcgcttcccagccgctcaatgtagtagtcccaatccagaatctgcatgtgcaggaaacgggcacagagaacagcaggtggcagcagccaagagtggggctcacttcatgctgagcacagggctaaccactgtgtcttatttaatcctctcagaaactctatgatgaaaggtgcccattgcacaacagaggacaccaaggcagggagcttcactgactcctctagatcacagagctagtaggtggctgagccaacacccctggccttagtccatccaatagaacagctaaagggccccaggcacttcatgttttcagttttgccctaaaaggttattaggtgctcacctattacttatcagaaaggaggaagtcaagagtgaagacgccagacaaaaaacataatccaactcagacatattctgctctgtctagctttccttgtaaacttttaagagtagagaacgcaactggcactcactgctcgaatatcaaagtcttgaagggaagagctcttgagccatttccggagaaagtgcttcctcaccgtgggctctgcttggaaaatggcaagtgggatggccctgggtaaggaagacaggcacacagctcagtaacagtgaaaatcacccaaaatctgatcctaactcttatcaaatgaacatggaaataaggacgtgtaacagctgttcacaaacatcaatgtatacatctgcgtgcatatgtatgcacaaacatgcctacaggttcctcggggagtaacacgtgcgtatgtgtaaacacgtgcgtgtgtgcacgtaaacatgtctacatgttcctcacagcgtaaccatgggcatgcatatacataaacacatgcgtgtgcgtagacatgtctgcgtttctcattgagtaaccacgtgcatgcgtacaggcaaacacgtgcatgttcgtaactatgtctacatgtttctcacggcataaccatgtgcatgcacatacataaacgcatgcgtgcgtaaacatgtctacgtttctgagtaaccacgcgcatgcgtataggcaaagacatgcgtgtgtgcgtaaacatgtctgcgtttctgagtaaccacgtgcatgcatacaggcaaacgtgcacgttcataaccatgtctacatgttccttgctgagtaacacacagaagactcaggctgctttctagaaaaaacgagcctgttttcatgtcactagcaaagcaactggcaaccgtcagtgcttccctttcactggaggaaacatctgtggtgaatactgcaaacataaggagacctaaagaagacacgcacactatgatccactcggctccatcaagcttcaacacttggccactctgacttcctttgtgagacgattagagtgaagccctgtgtgaccccaacctattccctcctcacacagaagtaaagacaacccttattctggtgttcatcaaccccatgcaggcatttgtactggtcctatttgtatataaccaccaaaaaaaaaaaaaaaaaaaaaaaaaaagagcagtttccatgtttttaagttttacatacacggaggcataagggtcttccttcaacctgatttttgcttttttctccaaagtggtttcaaactgtcagtgttgtaacctgtagctgcaattcaaccctttgaactctggtatagtgtatctcattccctacaaaatggcaattatccatttctggttgatggacacttatgccatccccaaacttggtgttaaacacagcccaaatctgtaaggaaccccttacctctccgtgacagggcagccctcacctctctgtgatgaggggagccctcacctctccgtgacggagggagccctcacctgtccgtgatgggaggagccctcacctctccgtgatggggggagccctcacctctccgtgacaggggagccctcgggcttgcgggagatgatgtagcggcaactcagccctgcatccttgaccatctggtctcccaggaactcggccaggcgctttgctgtgctgatggacgtagacttctgctccccgtaatcttccagcttccgagacatggaacggttctcagagatgagctcgaatagctcagagtcaggcatgttggctgcctagagaaagacaatgggtaaaacactgcagaaatcaaggggcagagtctgagctcaccctggactgtgctcctctaggccatgcccttctctagcctgagacgcagaaggctgcaatttcaagagctctctaatatgcctgtgtggcaatactttaaaacatacacacacacacaaaactttagcttttatattttttttgagacagagtctcattctgtcacccaggctggagtgcagtggtgcaatctcaactcactaaaacctcccctcctgggttcaagagattctcgtgcctcagcctcccaagtagctgagattacaggcacatgccatcacatccagctaatttttgtatttttagtagagaaagggttttgccatgttggccaggctggtttccaactcctgacctcaagtggtctgcccgccgaggcctcccaagtgctgggattacaggcgtgagccaccacgcctggcttggcttttattttattaaactgtgcacaaaatatcaagaagaatttactgaagagcaccaaggctgcagaaaaggatgttgctcggcctaagacaggaagtttttctccttgaaaggaagagaaagaaggggcaggaagagccagaagagaggaaagagaaactccggccggctggagagtggcctgagcagtggaggcctgagcagttccagtgtggcacccacatccagctggagctgtgctttgcacacatgttcctgaccacaggccccccacatcctgtaaggagtgctgggctcatgaatattctgtgtgataccctggtgctcccttgctcgtgtgtttcactctatacaagacaatatgccaagaaacagaagcccacacagcaaagcaagccaggaaagcactgcagagtgttccagtattccttctacccaagacgcctgtgcctgggaaacatatgcaccgagatatctcgttcaatgcaacaccattgataacaatggaaatgtgaaacctatctggtagtaaataatcgtgggctagttacgtaaattaaggtatgtaaactgtcaaaatgttatgtagcctgaaaaatataaaaaatacaaagtaacatagaaataaacaaatatcccaggctggagtgcagtggtgcagtcacggctcactgtggcctctacttcctggtctcaagtgatcctcccaagtagctgggaccacaggcacgcatcaccatgccaggcttatcacgctatttagaaaaacgtttccctcagagttgtgtccctggatgcagaagttgaggggaactccaagggggtaattgtgctcaggaggtcttgggatttcattaggactggccctgtgttcttcggtcaccttggtctccaggagcccaggaagcacggggtccccttcttgcttcatccttcatccctcagagcaggtgagggtggagggtaggcctttaccttgctgtacagcacgtccagccagtagtcagccaccttggctacagagccatacacctcttccagcgtgctgcccttgaggaaggcctcaaacaccgaggattggaagatcttaatcagctgcagttccccgcggcgtttgacctcaaagcccttgagctcagccagagaaccgtcttcattgaacacagcatacctgaaaaaaaaaaaaaaggcaagcacagcagtggcaaggagcgctggggagccaccagctgtgcctcatcctctctgcccgcctcttccctttccaaccctccacctgtcatccacgaggcagcaaacgtctctctcccttaggccactgcttctctaaaaggaaaatggctgaagggcctgcagccacagagccagaatacagcaggcgggcagacagagctggtgcaaacggaatcagtaagatcacaagaacccaggtctgtttctatcctggctcctgatccaacctcctttctgggctaaatttaatctatctcaatccatgtcctttctaaagcacaaaagctatgagagtcccacctcttcttcaatttcttgccttcttccttggaggctggaagaatcatggcaaggtagggcccatcaacctcaaaaaagatgctgttctctgagcgggtgacgtaggtgagtgaggacggctcagccagctcctggtactggtcattggtgaagccttcctgagaaacaagagtgaagagggggcagcttcactcatgatggcccaaacctggaaaccacctggtgtccctccaggagtggatggattgacaaaccgaggcttttccacataactaacacgacttggcagcaggaaggaaggaagttctgatgcatgcaaccaagtggtgaaactcaggtgtatctgttaggtccaagaagccagacccaaaatgctacaggccgtatgcttccctttacatgacattttcgacaaagcaaaattatagtacaaaaaacacattgtgggttgccagggtttcggggtagggagaggatttgctgacaaaggggttgcagctgttttgtgttgcttcgtggtgctggacacacacactatgcacttgtccaaacccacagggctgtacgctacagagtgaacgtcactgtgtgcaaattacaagccatccagccatggtgctgggatcccaagaggggtgcagactgggccaaatgagcccaacagcactgtggacatacagcagaacatgccaacagggtggggaggaaggagctgcccgtgaactctgctgactggacagggtaaggctgaaaacaaaagtaactatctacaaatgctgtacagtggctggtgaaattatttctcatgggacacaagtctgttagcaattctaaaactactttacatggactctaggattgaacaaacacatatattgagaaattcgaaacaggtttatcactgaaggagaaagaagtcactaataagaaaggggcagactcatgtgtttaaatgcatccatgcagacagacagacacagaaataaacagttctgtgtgcgtgcgttactagagacatacttcctggctgcctccactatgagagactggaagctatgacactcccaggaacagtgagcacagcaagcaccccatctcgggtttttacatcattcttctcggagaactggctgactccaggttggagcagggaaaatacaagatgaggctggtggaccttacagtaccaagaagtaggaaagtgctccagaaacaaagaccagaagagggcgtgtcccaagaacacgccacaaactaggaggccccagtggcccaaggggaacacgtggagcaggaagccactccggtcctatgaacaataaccctgggatgtccactctgatccgcaaatccacactgatgtcaataagcagacaaataaacgagaacaaatggaagagaaggatagcaacgcttccctacaggatcccaattgatacagtagaaggaatgaaggaaacagacaatcgccagagaaaaaccacgacaggaaacctcaggcgtaactgctgcaggtgcggcccaccagcaaacacagcccatcagcaacgctaacacagtgggcagaagcttatggagcagctgtggatacactgtctcgaagcacctgctccacgatatctatttgctgctgtgatggctctaatacaggtccagaaactctgacagccctcctccagggacgcttatatcctccccactgggtgtgtatttacgactgaagagccgtatgggagggggcacaggagcgccacagtaaggcctgcagaagcccctcaggcaggagactaagccgtccccacaacacacccacactcccacaccaccacaaaccaacacgatgcgtgtgagaacgtggggagggtgtcgcacctgtggagctcctccaaaaacccaaatcacctcagtctagtcacgagaaacaacagacaacccctgatcaagggacagccaaccatcgcctggccggcaccaccagagggggaggtcgtgacacgaggacagaccgggacaggacaactcggcgccacgtgggtccttgctgggatcctgggagagaagaggggctatggtgggaaatgggaaatccaggtgaggcctgcagtgcagttactggggcacagacataggtttcttagttttgacaagcgcaccatggtttatgcgaggtcagcattaggggaaggcaggttgaaggggatacagaaattctctgtactatttttgtaatttcctgtaagtttaaaattatttcaaaataaaaagttaaaagcaaaaaattctgggagctatgctgaaagagaaaggagtggaatcacttgatacctctgaccatggtcttcaggctatagaaaagcaatgtgagcagtgctgggtgccaggaaggcatgcacactgtgaggtgctgcagagccagtgacatcagggcactgacgccaggccagccagagcttcaggaccagaggccccagactcaccttgaccatgatgttcaacatggcgcctgggtaggagatggtcactttgggcttcttcacattggtcgtcttgaagacaaaattttctgggaagctgttgggcaggacgcaccatataccatctgtgtccagctctaagggcctccttcagagaaagagaggagcaaggtcgtgagttcccctttccttttcacccagtgtgtggcctccagccttccctccttccttcctgcccagtgtgtggcctccagccttccctccttccttcctgcccagtgtgtggcctccagccttccctccttccttcctgcccatgcttgcccccaggacctgctcccagccccacggctccccttctgcactcacccaatctgctcgatcagctcccgtgcctgggtgatgatgttggcccctgtgaagcagacgatgccagccatctccatggagtaccagcgagccctgagaggacaccacaaactggtgggtggggctggcatggctcctccagggggtatcagaggcagtgaggagtagggaggaggaaaggagagatgcgacagggacaagggaagcagccaaatgtgcgtgcaccaggacagaactaaggtggaatctggctctgcccgaggacacctctctgtccccaccttggtgcccaggaaggatctggaagggtgcagtatgtgccactgcgtccagccgttcaggactccagcctcagcaggactcttaataccacccagacccattcacgccttctctactctcttcacacctcctcccaagccccattctcacctccagcttctcagagaaagcccaggcctagctgccaggcccaaccctcctccagcctgggtcccagccctgctgtcagctgtcccaccctcccctcccggcaccagccccatgccccttgtcagttgcttctctgcccctcccggacacgcagacatgctgtgaagcaactgcccgacactctgcaagtccctgagtgaggatccacgctgggagacatgaacgcgctggaaaatggcaagtcgtgtctccagcccatgatgcagagacacatacaccccacagcacgcatcactcatggacacccagaccctcaaagtcagcgtggcccccactctcttcaacctcccagccccaccccagcccaaagccttctccctccaacattccttgaatcagatgaacggccctccatgcacagcagcctacacctgaagctgccctaaacgtggactcatccattcctcccataagcctctcccgggcccgggcccacctaccccttgcgcatgacatagccatagaaggagttcaggatgcacttgtgggccagctgcagcgagtcatacagcacctccatgttcttgcagcgcttcacctcagccgcgtcgcccacctccacggccgccgagagcttctttttccacacctgagaagcacatgaacatggagcacctcacagattcttccatttcacattctacaaagtcaatagcccaggtttttagtattttgaaaattttcaaatctatagaaaacctaaaaaaccagtacaatgaagagtgtacattcttctcctagactggccaactgtcaatattttgtcacacttcctttattctgtctctctgtgttgacagaatcatttgaacattgtagatttcacggtctgacatcctaaacgcttcagcacagtttctagggaacaagagctactcgggggtgcctggtaaaatcaatcaagaaatgcagctaagaccacagatgtctcatcaaattccccacccaacatgagaaaaggtttttaaaggctgggtatttaaggaacaaaagcaaattccttaagataattactgagtgcctagtatgtgccaggaactccattgtactctgaagcacgagacagtcactacacttttggtgcttatttgatgagggagacagatgaacaagtaatttagcagttgcttaattaaaataaagtgagatagtaaggcagctccttaaaaggtaaatgtagaattagcatatgacccaacaactctactgctgggtacatatccaaaatcaccaaaagcagagacctgaagacgcacttgcagcccatgttgaaaccaggattgctcgcgacagccaaaaggtggaagcaacccaagtgcacgtcggtgtatgaaggatagacaaaatgtgacaaatccacacaatgaaatattattcagccatttacaaaaatacagtacagatacacgctgtatgttgataaaccttgaaaacatcatactaagactgggcgcggtggctcacgcctgtaatcccagccctgtgggaggctggggtggatagatgacctgagttcaggactttgagaccagcctgggcaacatggtgaaaccccgtctctaccaaacatacaacgatcaggcgtgatggtacgcctgtggtcccaggaactggggaggctgaggcgggaggatcacttgagcctgggaggtggaggctgcagtgagccaaggtcacaccactgtgctccaaccttggtgacagagtgagaccccgtctccaaaaaagaaagcatcatgctaagtgaaaaagccggtcacaaagatacaaatactgcacggttcacttacatgacatccctagagtcgtggaattcagagagagaaagtggaatggggtcactaggggccagggaggaggtggggagctactgtttgatggagataagagtttccgtttcagaaggcgaagaattctggaggtagatggtggtgatagttgcacaacagtgcgaatatgcttcatgcccctgaactgagcacttaaaaacactaaatgtcatattatgtccgccttaccattataaaaaagaacatgtgacgatgagttcagcagggcagtgcaggatgccagggggccgcacagcaggggccgtgctgagtctacagtgaaggtctctcagaaaaaaaatggctcaatctgatcagatataaaataatgacccgttggtatcaaaacagaggtgttgctatgcattttccatgttcctaccggatgaaatacgtcagttaaacacgaggggccggatggtgaataccatagatgagaaggccttagagtttctaggaactcctcacctcccatgacagcgggaaagagataaacaataggcgaaggcagttgggttcgtaaaacttgatgtactcaaacggccagccagctgtagcttgctgacccctgctctaaataatcactttagaaatcatcctttagggtccttctgaggcctcagaccagggtggatgatggtctgcatccttcgtggccatcaactcttccaagtcaaaaacaattgcacgttaccatccgagtgcaagtgcctgctcagaggatcccaggcaaggagccaagagtgcccacttcatgagccgactgaaactgccctcacagaggccaaagcttgcagcccctcagagctcaccttgtggagccctttgaactcgtaacgcctgtcccggaaggcacgcacggtgtccacgtagaaggagttttcccgctggcagatggtggtgagacgctcttccaccttggtgatgtggatcttcttgtaggctttccggcagtaatctaagcacgacggagatgggcagagcaggtgggtgagatctcccagagcagagggagccagggcacaggggtgctgaagaacatggcttctacgtcaccacaaaggagcaacagctcagatacactgctagtttctcataccgaaaaaggtgggcgggcacggtggctcacacctgtaatcccagcactttgggaggccgaggcaggcggatcacttgagcccaggagtttgagaccagcctaggcaacatggcaagaccccatctctacaaaaaatacaaaaaattagctaggcatggtggcgcacacctgtagtcccagctacttaggaggctgagatgggaggattgccggtgcctgggaggttgaggctgcagtgagccaagatcacaccactgcattccagcctgggtgacagagtgagacctcatttcaaaaaaaaaaagaaagaaataggacagcccaggggtaggaacaggccaaataccccaagaccacagagcagcagtgtctaacacttgcagatggggaagcaaataaaggaccctgcagtgagagcacagcttacagtgacctagagcagcttctggtctgctgtgacaacacctctggggccccagctgggatggaccaacgcagcccagtaagaacagaaagtgggagcaggagccacatctttacagccgtgaccatgcccaggcactcacccgccagccttctcttctcgtatttcgcctgttcctcgcgggacagttcatgaaaggcccgagctggcccctctgggaacaagggggggaacttctctgactccagctggtgctggatccgatggtattcgctgcgactggctggcactgggaaggaggcaatgggggcaagttcaaaaggaggcacagacacaccggcttcccaccaagtggagaaaggcggccgacactcacccacccgtttcccaccgagtgcccacccaggcggccgacactcactgaactcgcccctccactgccaggccatcttccgctggcagtttgctccaggcttattgaagtcacaggcagcacaggtggcttcgtccaccatggcagagggctgggaggggtgagaaagcacttagggctgggcagagagagctccgactctgacacgggaagtaaagtctcacctgcaggcggttggtcaggatgatgttggggtacatggcccccacgtccaggtggtagatgagtggacactcgatgcggctgggaacgtccttcagggaggcaagcttgctcttaatctcatcacacacctgcagagaaagcgaaactcagtagaggctggtgaccaagcttgcctcgtgtgcagttcaccaaccccttttagacattcaggagaggaaaaagctgaaaaatatataaatagagcaaaaactagccagaagaaaaaagttaagaagggttgccatcatttctatgaaatacattaaatttggtggagtcattagaaaattacttgaacactaaactctccttagtattaaaaaaaatccttaggccaggtgcagtggttcatgcttgtaatcctagcactttcggagaccgaggccagaggatcacttgagcccaggagttcgagaccagcctgagcaacacagtgggacccccgtctctataaaaaataaaaaattagccgtgtgtggcggtggcacctgtagtcccagctactcggaacgctggggtggaagaatcgcttgagcccgtgaggtcaaggctgtagtgagcccagattgcaccactgcactccagcctgggcaacagagccagatcctgtttcagaaaaaaaaaaagaaaaagaaaaatccttaaaaccctccaaagtagtaaaaatagaaaacacacctaaaattttaagaaaaaagtgattacaaggaataacatctattccatagaacaggaaataccacaacagtaacacctattgtttctacttgaattacagataaacgaatcagccggggaagagcctccactgcacccttctctgcccagtaacggcgtgttctgaaaggctgtccagtcaagaaggggaggatgggctgggacaagtgaatggccaagtttccatggtggggacaccacctggacatgccccacgtggctgtgagcccctgctgacatccccccagccaccctccgcccaacaggtgacccttcagggacacaaaggcgatcctgggcttccctttcaagggcacttgcgaggacttaggaatcgctaacaggacaatgtcatctacagagctcccttcctcactcaccagggagcctggcgtcctcacatctacagagctctcttcctcactcaccagggagcctggcatcctcacatctaccacacctccagcctcactctacctgcccatctcactgtttcttaaagactttaaatatctgcttctaggtcgggcgcggtggctcacgcctgtaatcccagcactttgggaggccaagcgggcagatcagctgaggtcgggagttcgagaccagcctggccaacatggagaaaccctgtctctactaaaaatacaaaaaaaaaattacccaggcgtggtggcaagcgcctgttatcccagctactcaggaggctgaggcaggagaatctcttgaacccaggaggcagaggttgtggtgagccgagatcatgccattgcactccagcctgggcaacaagagtgaaactctgtctcagattctgagacgtctcgccaccacgcctgggtaatttttttttgtatttttagtagagacggggtttctccatgttggccaggctggtctcaaactcctgacctcaggtgatccacccgcctcagcctcccaaaatgctgggattccaggctgcccaggctggagtgtagtggagcgatctcggctcactgcaagctccgcctcccgggttcttgctattctcctgcctcagcctcccgagtagctgggactacaggtgcccgccaccacgcccggctaatttttttatatttttttagtagagacggggtttcaccgtgttagccaggatggtctcaatctcctgacctcgtgatccacctcggcctcccaaagtgctggaattacaggcgtgagccaccgtgcccggccatggccgacattctttaactcctatttgttattcagacaaggctctcttcctgatcggttcataagagttccctgaagtataataatggatgtggctgacaatagccaaacagtgcttcacagcttgccaagagtgtacacatattcttgtttaaattttgactagtgaatctattacaagatgtttcttgagggcaggcacagtggctcacacctgtaatcccagcactttgggaggctgaggtgggcagatcacttacagtcaggagttcgaaagcagcctggccaacgtggtgaaacctcatctctactaaaaatacaaaaattggccaggcatggtggtgggcacctgtaatcccagctactcaggaggctgagacaggagaatcgcttgaacccaggaggcaaaggttgcagtaagccgagatcatgccattgcactccagtgtgggtgacagagcaagactccgtctcaaaaaaaaaaaaaaaaaaaaaaaaagtttcttggcatcaatgtgaaaactgttaaaaactctaaaccagcaacctcactgaacatgatgtagtgctgcacagtgcctgacataaagacctgagataggccaggcgcggtgcctcacacctgtaatcccagcactttgggaggccaaggcaggcggatcacaaggtcaggagttcaagatcagactggacaacatggtgaaaccctgtctctactaaaaatacaaaaactagccaggtgtggtggcggatgcctgtaatcccagctactggggagcctgaggcaggagaattgcttgaacccgggaggcagaggttgcagtgagccaaactcatgccattgcactccagcccaggccaacaacagcgagactccatctcaaaaagggaaaaaaaaaaaaaaaaaaaaaaaagacctgagatgtgccatgtcctgaggaacagggatcagagaagaactggtgtctccctctccagtcacataacacactttgtaagtgtgctttctaaccattatgtaaacagattttacagtcactaatcctgtcatttgtaggaatttactgtcatttttaagtctcaacaacaaaaagtaaataaaatttaaaacctccaatggctccccagtgcctataaaataaagtcctaatgctttaaaacaggacacgggatacatcccaccaggacccaccttccatgttactgcatttcaggagcagctcacaccccacctctcatgaagccctccgaccttgtgacagcatcacacgtcacaaccatgactgccctgtcccaccagagaccctgtgtcatccgtccacagcaccacacgcagcaggtgcacaataaacgtgctgctgaaagacgtggtctgtgaagaaggcgccaaacacagactggctcttcctgcctccctgatggttacctcttcaaagttggtgacttgctccacaggcactttctcctcttcctcaagggcgtggcgcaaggtcttctcaacccgctgcagcaggaagtcaaaggcggcaggattctagcacaacagtgagacgacggggtcagaggggaaacacacccacactagcctgcctcaggtttgacgctgtggctgcacgtggcaggttgtgcccgagaaagctccggaaggactcatgtgcacaatctgcagtgcactgccctaaagaagcccccggggggtgctgggccagagaagccacacccggtgaggggccgtgggacaggatggggagaaggggctttatttcagcccctgcagcttctgggtcctaccacagcacaagagtgggaagaatctgaatcccagggaagaagcacaccatcctaaaccggcaagggatatcgctgcggaaaaccccagactcgagggcctccacgtggcccccgacgtaggtctcagagtccagcacgtgtccgtcgtccgtcagcttattgaactcctgctcttgcttgttggggaagatgatgttggcgtggaaggcctgcaccatcagcaaggcctcacacagagtgccagagcccttccgcagcacctgcaagagaaaccaaggcttccagccaaaagcaacaccaaaggccctgacttgcaggcaaagtccaggaacctaagctgaacttcagtgtgaaaggagagaaaacctcgtggtaaatggctgcaaattctgcctcctgtggtttcttcctcacaccagggccagagaattcccaaaggacatccctgacgtcacacaccagaattctactgccgcctctggtgccagcactcctgggacatccacctccattcagctccagtgcatttggaatggggcaagggctgaggaggccagggtgccgacaggacagataatgctcacctcgtcgggctccatgggaataatggtgcacagagcaaagatgaatgggtggacgtacttcatgtacaggtagtaagtggcgacagcatctgacacagaatacgtggccagagtctgaggagagaacgccagagagcagggccatcaaaaatcaagagcccagggtcaagtgtgaagcacagaaagcaaagcctggcctgaccagcctgccgcacacacagtaaggagaccggcacaggacaaaacacgtgtgtcccggagacacagcctgctgggtggagcgggctggcatacatgcgtgcacacggcagcagggggagccgggatgtggctcacatgcctggggctgctccgtggccatctggatgcgtgcacacggcagcaggggcagccgggatgtggcttacgtgcctggggctgctccgtggccatccggcacatgtcctccgggtctagctccacgggatcatagcctagcttggccttggcggccgccttgagattatgactgcccacaggaaggtaactgtccctcttcacccacctggaaggagaatgagaacagaagccaggatgattctaacatgcagcccgggaacccctgagaactggcaaaactgggcaccacacagacagatgcaagttcctaacaggcacccaggagcctcacaccaaggccccacatggtgtagacaccttgtgaaaacccttcatcaggatctagttaatctcacagacctatccacaacacaaggaagcaccaggactggtccttccggccctcgccttcctcccatcctcagcagagtttgtggcctctccgacgggcgccccacctccttgggcctctccccagacctcaggtctgcacccctggggcctagttctatcaaccacactgatcttctctcctcacactgtcccttcagcacggaaacactcaagcccaccctcctttaatagaaggcaagatgtgatcagatgccaagaagaataaaaatttaaaaaataaataaaaaataaaaattaagaaaagaaggccccccacactctacccggaacctgtctctacctcctccctacagacgcattccctggagcagctgtccaggggtcatgtccggtctccaccccccgcagcctccaccctgtggccttcttctctcactttacctcttgccttcagttcatccactaccccagctttcaccaagacccacccgcaacccagtgagtcccaatctacagtgcgagcccaaaccaagcctcatggtggtcttcagggcccccatatgggtggggcttccaggctagcatatcggtagcagggtcacctcctgcctcaagccccttctctacccattccctgtctccacggatggcacaaaaaccccaggtgccaacccctccctaagaaccagcatccctgggcctccccctgccccacatgacagatcctgaatcctcacaaccctcactccctgccttggatcaggactgtcacaccgtcacacgctaaaccggccccagcctcctggcctccctctccaagccaagtgctgagcatcagagctaaacagaaacgcattcaggctgcaagcaccccagtggcactgtgcagaatacagaggccgtggaggcccctccattcccttccttccctccctcccttcccttccttccctccctcccttcccttccttcccttccctcctttcctccctcccttcccttccttcccttccagcctccttctgttggcatttccacatccacctgtcttcccaaccagtcatgtcagagcccccgaacgccgtgactctccgaagctctgagctgcctcccaccctagctcatatggaatctgtggttgtcccgtgaggcttgtcctgtgaggcagccgggctgccacatcccaaccttgcctgggcagagcagctccatgaggtcctaggtctgggacctgtcagctgagtgcgtctttccagcggcttccccaccccagaggctgatgctcaatgtgcctggtcactgatgaattgtcagtcaacagtcaaagacagcacatcccgggccctggcagggttgcagctgccatactcttgggtgacctgaaacggcctctcggaggccaccctcctcccatgagatgtggtgacagcacagtctgcaagaggccttcagatctcgctcacggacagcagtgaggagccatgctgctctgtggcccctacctgaggcagtccatgtggatgcactggggcgccttgtactccccctggctgtccttctggaagcctatctcctgctgcatgctcagaccgtggactgctgcccgggcctccacaaatggcctgggttggaaagaggacagacaagcaagtgggcaggtcaggctctaatgcccctttctccattcctccctcagacccagggaggaacccagacacgggaggtgcagagtgaacccaggagccacctcctaagtcgacatgggaagcgcccctgcaccacgcaacgccctccctctcaaatgctgcccagttactcatagagaagacacagactcaccagtcaaaaaagtccccgttgtaggtgaccatgatggtgggtttggtctcctggacgtgttcaaaccacctttggatcagatgagcctgaacccaagtcacagcagtcagaggtctgctctttctcttcttcaagctattccaaattcctctcccaaagttcagaagcagcagcctcatgttggcccttattcctgccccgcccctccgcccgtctctggcagaaaagacggtcataccctgagaacaaagctcatggagctgcaattctgatctgacggaatgcctgaggccttggaaagatccacatgtccgttcttcccacaataccgggtagtttcccaagtgatacctccttacctcatcgggttcattgaagacacaaaaggggccttcatattctggcttgggggtgaactcaaaatcttcaatatcttctgaaacaatctccctgttggtgatgaggtagccctagccaagttcattagcaatcagcacaagtcagaggctgcaaagccaagaaatggcgttcccaccctgcccacacactctgcctagagattctcactacaaagaagtccacagcaatgtgaaagtgctttaagcttcctgagaagagacgctctgtgtgtggattcccactcgaaaggggagggtacagctggaggtcggaacggcttggttgctcccattcctggactaactcattattcactcaacaaatactaacagtggggcagatgctgctgtagtatggggaccagacaaggtccccatcccaggagcttacttcccagaagccacctgctcacctggccatcgatcatgtaggaaatcatcataatctggtctgtctcagcatcaggaaacttgaggggcagtttggtcgtctcaatgtcaaatgccaaaaccacagggtcctgtggggacaaaataagcataaagccaagctctaaactccccattaggcctccctgaacacccacccccagcctgctctacctccctctggttgttaaaagagtcaaaaggctctagagctgggagaaggaccctaagactaaccaacctacatcaagagtatcacgactccctatggtatgaaaactgacatacctaagagagcagctgatcacaggacaagcctaaaatcacagaactttaggagaaaaactcttcaaaagacatcacctcattctggtggttatgacaactctgaaaggtaactgtggcacagagatgatatcttcatttcggaaaagagaaaactgaatacaaagactttcccaacaccacaaagtcatgtttgaaccaaggccttctagttacaaatccatttttcaccatgtcccttcactatcaactacccaaacggaagtcccagctttccctcgagtgtccaaatcctgcctagctcaaacactgatgtcatacagtgatatacaacaaaaaaggaaatgatactgtcagaaactgatgaaaaattctaactccatatttcctttaataaagtatttgggggaaaagcagcaaacatatctttgagtcagattcactctccagcactgaagaatattctctccagaaaactggaaattttaggatgaaggtaacacaagcaaaacttacaggtcgttcaacaaggtcatctcggcgggtgatttctaccggaaaagcatttcctcggtatctgacattgtaccaatgagcctgcaaaacacacagtgtgctaactagagttctacatccaggaaagtctattcttctgtggattcacccataatgatcatctcctggctgttaggaaattcatgtgagcagcgacccaaccctgccccactcaccacgtggatcttcaggtcaatggagaggcggatgtggtagggaacatcgtactcgcgcatgtccacaatgttgtccaactggtcagctatcttcttagaggtttcctcttcatcagtaatgacaccgcccctctgcagaacactaggaattaacaagagagcaactaactcagctgccagggtctggaggaggtgagaccagagttccaactcagtaggaagaggtgagaccagagttcaaaccgaggaaacacaaaaggtaaattgatgtggtttcaacgaccaaggcagtccttcctttaagaatggcttggactgggccaggcgtggcagctcacgcctgtaatcccagcactttgggaggccaaggaaggcggatcacccgaggtcaggagttcgagacgagcctggccaacacgacgaaacctcatctctactaaaaatacaaaaattagccaggcgtggtggcgcatgtctgtaaccccagatacctgggaggctgaggcaggagaatcacttgaacccaggaggcggaggttgcagtgaacccagattgcgccactgcactccagcctgggcaacagagcgagactccatctcaaaaaaataaagaatagcttggatgataactctacagacaggagaaaattcagtgtaagatgtattcattttatatgatgtgagttacaccccaactagaaaaaaaaaaagagggccaagcatggtggcttatgcctctaatcccagcactctgggaggcaggaggatcgcttcggcccaggagttcaagacaggcctgggcaacatagggagactcatctctacaaaagtaataataataataataataattagccaggcatggggtacacacctgtgatcccagttactcaggaggctgaggtgaaaggatcgcttgagcccaggagttcgaggccacagtgagctatgattgcaccactgcactccagcctgggcaacagagcaagaccctgtctcaaaacaaataagtaaatagaagaaaaaagaaagaaaacattaagtgctgccagtcaggagagccaggcatgaccatcccaccatggtcctgatactcaggaggctgcctcatgcaggctgaagagcaggcctgggcttcacacagcctgtgcatgggtctctgccatgtctaaagaagtggcccaccattgcggccactattggcctataagctcaaatactgaacgggctattcagggggaaaaagacagacgagtctcagatatggctcaagtctctgaggactcagtctctgatcacaccttccaatatttcaaaaagcaacttgtggcattgccagggaaggcggactccgggtagggactgtagaaatgttcagcatcccaaactgatcctcttttgtcagagggtaaggtaggttcttccgaagtcatctaaacttcattactcaagattttctcttcctaactggttactttgcatcctattattgttgatgctcaaatacttgaagaacagtgtttagtgttctaggcttaaatttctgtggacgatacccaaggttctctggagatgtgctgtgtaaatctcagcacttaatgaaattcatagatggattgtgttagggcagtaggatgagggatcttttcccctctaaggtgactttactattacaaccactcaattttagagccataaacccacccctccattggaaaagagagctaacacataaaatataacctgggaagccactgtttatttaacacagaacatacagaaatctctacctaattgctcaagttttccgtatcaaacagagccagccattaaggtaactttgttgctacgtgttcctgtctcctatccatcttgtcgttctgaaccgctgatgctttgctcacaagaccaaagtttacctggaaagcagagctgtgtacgcgtcgctggcgtgatcctgctccctgttcttcttcacggcaggggagatctccttcctcactttgacaagatcctccacagtgtggaaggacagcctgatgtaatttcgcttcaaacccaccaagtgatttggctataatgcgaagagatcacgctcattggttcaagagaaataggactttatgggtgagagggtaaacactcaaaggtaaacacacaagtcaaagagttggcgacttcaaggcaccttgtccaactctgcacgtggcaccaactaacaccactagagctctttggaaggaattttatagacggtcaccacaccgccccatcacccaacagatgacctgaatttctacctcttccgatcccacctgccaggaacaatgtagactctggcctcatttacccctggaaagtctgggtgatactcaccaagtccagatcctctttggggacagtctccacttttgcaattttgccctgaaacttcttggagagaaaagatgaaacttctcgctcacaaccctaatcaggatcagaatgaaaaggctttccattggtaaaatacatttccttccttgcctatttcccagttgcaaagcccaccacagaatgacacacaggtcgtctgacctgagtctatgaaacacactcacctttctggtcgcaatgtagaaatacggtttatagggcaaagccacctgttaagagtcaccaacccatccaggggtgatgagaaagaagaaagcgagagaaaagtgaaaacacattgcttgctcctatatcccatgaacagcctagggccagggtagccttgaccttggtagcatacaggaagtcagaatgcgcacttttcacaggggcaagaatctgaaagacacgctacttctcaccattcagagtcttcctgaactgacctctctcaggacatcttacgtgatgactgatggggcctccaggggcccgagttctgctgggctatgggctgctgtgcactggaagcctcccatgccctccctgacagtcacagagctacatgaacacccataaaagtgggttttagcttgtcgcagtcaggggcttaccttaaatctgcttccgtcatcttgaataaagtagtaatccactgcactgcctaagcgcttatcttcatctaaaatctcggtctacaagagaatcagtcaacacagacacaagaccatcctctacacagttagagaaactttcctcctacctttcgggaaactcagcactttagaaacaaaccctctcatctaggtctttactccacccctacattaacactaccagccttattcacaagaaccacactgtaacggcctccaaatggggatctctctcaatttctccctcataatccttgaaagctttattctgatggctaaaagagatgcccatcacctccggcttctcacagtggcctctctgtggccctcaatgacgttaaagaggaaaggagagctgggaaccttcacatctcccacctgattcactcaaagttccctcatgtgtcccccactctttagataaggaccacgctatgaccagaagggttgcagccatattcctgggtgggagaaggacctagtgcttacaggatgcatgttaatgagccagcctgtcttctcaccaggctccttcagccgctcaaaaccaaaccgcaaatccatcttatccgtccactgactccgttccaggcgcttgagtgccgaaactgaggaagtggcgccatcatccctgagtgaaagaagggaaccccgtgcttaatttgtaatgccacctgctgctgcttctttttttcttttttttctttttttttgagacggagtcttgctctgtcgcctaggctggagtgcagtggtgtgatctcggctcactgcaagctccgcctcccgggttcacgccattctcctgcctcagcctcccgagtagctgggaccacaggcgacagccaccacgcctggctaattttttgtatttttagtagagacggggtttcaccgtgttagccaggatggtctcgatctcctgaccttgtgatccgactgccacctacttctgcaaccctcatcccacctagtgttaagtgtttcggatatgacagggtatatatattcctgaaaaaccccgagcttggaaaaaggctcattaagataaaaggactcattggaaaaacacaattagggcaggcccttcaaaacctgttcaactttataaccagaatactaacaaaaagagtcatgatggctagacactgttgcctcttgggacactaaaaatgcataaaactagccagacgcggtggctcatgagagtgcatgtaacactgacatgatttgaataaaacagacggattgtcaggccaggcacagtggctcacgcctgtaatcccaaaactttgggaggccaaggcgggtggatcacctgaggtcaggagtttgagaccagcctggccagcatggtgaaaccctgtctctactaaaaatacaaaaaattaaatcccagcaccgtgggaggccgaggcgggcggatcacgaggtgaggagatctagaccatcctgctaatacagtgaaaccccgtctttactaaaaatacaaaaacttagccaggcgtggtggtgggtgcctatagtcccagctactcaggaggctgaggcaggagaatggcgtgaacccaggaggtggagcttgcagtgagccgagaacgcgccaccacactccagcctgggcagcagagcgagactccggcaaaaaaaaaaaaataaataaaaataaataaataaataaataaattagctgggtgtggtggggtgggcctataatcccagctactcaggaggctgaggcaggagaatcacttgaaccctagaggtggaggttgcagtgagccaagattgcgccactgcactccagcctgggtgacaagagtgaaacttcgtctcaaaaaaataaataaaataaaataagataaaataaattagatgggtcgtctcaatgtcaatttcttagttgtgacaattgtactctacttacacaagatgttatggtgaagtgatacgggaatctctgtatcatttctgacaaatgcatgagaatcaatctacaattacctcaaaaaaaggttgagggccaggcgcagtggctcacaactgtaatcccagcactttgggaggccaaggagggtggatgacttgaggccaggagtttgagaccatcctggctaacatggtgaaaccccgtctctactaaaaatacgaaaaattagccgggcgtggtggcgggcgcctgtagtcccagctactcgggaggctgaggcaggagaatggcgtgaatccaggaggcagagcttgcagtgagctgggatcatgccactgcactccagcctgggcgacagagcgagactccgtctaaaaaaaaaataaaataaaaaaagaacaagataaaaaaagaaaggaagacccttcctttgtctgaaggtattccttggatcaccttcaactcaagagcagaatgaccatattccaagactaggatccttacttctcatgaaagattataaccacttgtggtaggcaggcaggatgacaccccccatgaaagacccacatcctaatcccccaaacctgtgaatgttatcttacaagacaaaagggtctttgcagatctgactaaattaagggccttgagattctgcttagctgggtgggcgcagtgtaatcacaagaatccttgtagagtgaggcaggagagctagagtcaggaaggagaaagggatgggagagagagggtaggggggagaggagatgcaacccttggttctgaagatgaagaagcagcaaggaaacagattctcccccgggaaccatcacaataaatataaccaaccagacactttcatattacgacttctgacttctaaaaccgtaagagaataaatttatatagtcactaagtgatcatgtgttactgcagcaataggaaactgatacaccaccatactgtataataaaggtttaatcttttaaatagttgaatgcacccgtaatcaaaaacacagaaaaactatattccaaatcttgctagagaacagcctcagttctgagtcccagatctttatcaaaatcaagagtgaatgaagtgctatttacgaggcatcacctcttaacaggggcgcacggccctctatgccagtcctccaaatatccttgcctcaagtaagttggattaagtagactagaaaactgctcactgggaccatatttcctcccaaaactgctttctctgagctgtgtatctcacttttaatccagggacagtaagaaatctgaaaaatggggataagtgtcacacagggagctaccatcgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccactgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccattgactggttactgtatcacacaatcccagtactccacaggctctcattcacagagctaccattgactggttactatatcacaccgtcccagtactccacacaggctctcattcacagagagctaccattgactggttactatatcacaccgtcccagtactccacacaggctttcattcacagagctaccattgactggttactgtatcacaccgtcccagtactacacacaggctctcattcacagagagctaccattgactggttactgtatcacactgtcccagtactccacacaggctctcattcacagagagctaccattgactggttactgtatcacaccgtcccagtactccacatatgctctcattcagttttcatgacaacccctacgagggaggccactggtgtccccatttcacacaagaagaaacgcaggcaaacagcacccactgcctcctggggcacactcacctcccaggactgttttaaggatgagatgaggtaacccacataaagcatgtaaggtaaaagccatcacttgtacttatcccagcagcagccttccccctgcctggaggccatcactgagcttggggcagggcagtggagtggagcacgtgagtgcagtcctgtgtcctgaagcagggcagtcagtaaccgtctctaagctccaagttccaacacaccatgtagaccctaagggtacctgcctctctagggcttgcctgatatggacagacagcgatgagcacaacagcagttagggatccttaccacttggtttctcctctgggaagaattttgttcagctaagtgtctgtaaaaagcttcacgttctcacacgttttttctatttttttttttttgagacagagtttcattctttgttgcccagcctggagtgcaatggcgcgatctcggttcaccgcaacctccgcctgccgcgttcaagtgattctcctgcctcagcctcctgcgtagctgggattacaggcatgcgccaccacgccccgctaattttgtatttttttagtggagacgggatttctccatgttggtcaggctggtctcgaactcctgacctcaggtgatcctcctgcctcggcctcccaaagtgctgggattacaggtgtgagccaccgcgccgggcctcatccgttttctgcttatggcaggccagtcctccggtcatgtttaccgtttgctctggccaccaagcagccgcgtcttatccttgctctattttttttgagactgggtctggctccgtcgcccaggctggagtgcggtggcgcgatcccggctcacagcagccttgacctgccgggctcaggtgaacctccggctcggattcgggagtattaatagctgggacctcgggcgcgcaccaccagcctgtctaatttttcttgtttttacaagagaagggccgggcgcggagtctcacgtctgtaatcccagcactttggaaggccgaggcgggcggatcacctgaggtcaggagttcgagaccagcctggccaacatggtgaaacccggtctctactaaaaatacaaaaactagccgggcctggtggcgggcgcctgtaattccagctactcgggaggctgaggcagcgggatcgcttgaacccgggaagcagaggttgcagtgagccgagatcgcgccactgcactccagcctgggcgacagagcgggactccctgcccaaaaaaataaaacagaggagacgaggtctctctctgtagcccaggctgatctagaacaggatcctgggctccagcgatccgcccgcctcggcctcccccagcgctaggcccccaggcagggtccccggccccgcccctccccgcaccctccccagccgcgcgtccaccccgcagggcctggcccgggtcccgccgctctcatcgcccccgccgcgcggcaggtcccaaacgcagctgcgcggaaggcgaggcccgaaaaacctcagaaagagccgagcagggaaaggccgcgcggcccgcctcgtttccccgcaaagaagccgcgcccgtagcgcctccgcccgccccgagcccctccgtcggcggtcggggcgcgccgccctaccccagtcaggcgcggcgagtgcgggcggctgcgggaaccgggcctccctcccgcctcggcggcgccagccgaggacggccccatggcaccctccggagggccggcccgagagcctcaggagggcgcccctcacctgctggcctcgccatccgcgcctgggtccgcgcgccgccgcccgccgctcctcagagacatggagccgttggctaccacctctgcttcaggggagaaatttggcgcgctcccacccagactcgcgagagccggaaatgccgccgtccatcaagaggcgcgctccgcccctcccccgccccccgaggcgctccaattggcgccggcgcccggcgggggaggtggccggcagggaccggggaaaagtgtgtggtaggcgcgcgcggcgcaccgtggggttgggaccgggcggcgctgcgggccgcggtggggccggaaatgtcaggcggtccccactccgctctcggcgcctcgggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacctgctcttcctgcggctctacccggtgctcaccaaggcggccaccaggtgagcgggggcgcgggaatcggacgccgccccggccccaggtcggccgcagcggcgcggggcctggacgggagcgccgggccgggaccaggctgggggcgcgcccgggtcagaacccccggagcgggcgccctccgacccggcgctgaacttcccgcggcgacacccgcgtccgcagtcagcgattgtgaggcgccttgcggatcccgccctcccagcgcgtggagggcccgcccagacccgggggtcggcgctgaggttccacccaaggacccaacaggggccccgcgcgcccggggaagccacggcaaggggagcgggtccgcaggcgcgggtgaagacagggcgaggggagcgggtctgcggggcgcgggtgaagacagggcgaggggagcgggtctgcggggcgcgggtgaagacagggcgaggggagcgggtcttgggggcgcgggtgaagacagggcgaggggagcgggtctgcggggcgcgggtgaagacagggccaggggagcgggtctgcggggcacgggtgaagacagggccaggggagcgggtcctcatggagcgtgtggagacagggccaagggagcgagtctgcggggcgcgggtgaagacagcgccaggggagcgggtcttgggggcgcgggtaaagacagggccaggggagcgggtcctcatggcgcgggtggagacagggccaagggagcgggtctgcggggcgcgggtgaagacagggccaagggagcgggtctgcggggcgcgggtgaagacagggcgaggggagcgggtctgcggggcacgggtaaagacagggccaagggagcgggtctgcgtggtgcgggtgaagacagggccaggggagcgggtctgcggggcacgggtgaagacagggcgaggggagcgggtcttgggggcgcgggtgaagacagggccaggggagcgggtctgcggggcacgggtgaagacagggcgaggggagcgggtcttgggggcgcgggtgaagacagggccaggggagcgggtctgcggggcacgggtgaagacagggcgaggggagcgggtcttgggggcgcgggtgaagacagggccaggggagcgggtctgcggggcacgggtgaagacagggccaggggagcgggtcctcatggagcgtgtggagacagggccaagggagcgagtctgcggggcgcgggtgaagacagcgccaggggagcgggtcttgggggcgcgggtaaagacagggccaggggagcgggtcctcatggcgcgggtggagacagggccaagggagcgggtctgcggggcgcgggtgaagacagggccaagggagcgggtctgcggggcgcgggtgaagacagggcgaggggagcgggtctgcggggcacgggtaaagacagggccaagggagcgggtctgcgtggtgcgggtgaagacagggccaggggagcgggtccacatggagcgtgtggagacagggccaagggagcgagtctgcggggcgcgggtccgcacggcgcgggtggagacacggccagggaaggtgttttgagaaggtgacattgaacaggctgtgtaaagaagtggagcagaggctctcctggcacagggaacagcagggcaaaggtctctgttaggttttgaagggaaggccggcgttaaagaaaggcggagagaggtgcagcttggactcagtcccgagggagggaagatctgtgtgtggagaaagtgaaccctgagcaagaggcaggagatgtgaagggaatcgccagggatctgatcgagaaggtgtctaggtccgtgctaggaattttggattttatagtccagagagcttctcagaaggcaaatacaaaccaaggcctggagggagccactgggcctgttccacctttttatggaaatttttattgtgataattgtagattcacaaacagttacaagactaacatggagagattccttgcacaccttcccagtgtcccccattggttacattctgtgaaacgtagtgcagtatcgaccagggcattgcgtggacacagtccacagatcctattcggatttctccatttttcttgtagctgtatctgttctgtacagttttatcacatctgtacattcttgtgttcactaccacagtcaaaatgcagaacagcgtcatgatagggctgtcctgttgcccgttcataaccacacagcttcccaactcccaaactgccaaattatagtataacatcacagccaggatgttgacatagatactggaaagccacttgtccttacctgtgtgtttaagtccaccgtctccaccttttgatacaagaactatacattgcagccgctttaacaagaattcctaccccccgcccatctgctgcatggcctcagaacggccctgctaattcacctatgggaaagggacaccctcctgctggtcactgctgttttctgatgacctccctctccacagtggcattttgtcagcacttgggaacttcctggcccagatgattgagaagaagcggaaaaaagaaaactctagaagtctggatgtcggtgggcctctgagatatgccgtttacgggtgagtgccatacaaggggtgggtttaccttgtagccgctgagtgcaaccaagctgggcaccaaaaccgagtagttggagtactcttatttggaaatataattttttaaaaaccattgtagtaatcatcatgggaaaaaactcgaatggttcatatagtttgtatggcatatatacgcatacgtggttttttttgttttttctttttttttggagacagagtctcactctgtcacccaggcttactgcaacctctgcctctctggttcaagtgattctcctgcctcagcctctcaaatagctgggattacaggcacacaccgccatgcccagctaatttttgttatttttagtagagatggggtttcaccatgttggccaggctggtcttgaactcctgacctcaagtgatccaccttccttggcctcccaaagtgctgggattacagtgctaggagtacaggctcacatttgtggttttatcatgtttctttttaattggatgggtaggggtgactgtcttaattgggctgagaggcaaacctgaggacaagtaactcaacttaacctaaagtcagacttcaggattcaaaaaccctgaaagcgtcctagactgggctcatggaaagggaaaactgactccaatttgaccagttagtttctattgttattttaattttttttttttttttttgagacggaatctcactctgctgcccagactggagtgcggtggcgcgatcttggcttactgcaagctctgcctcctgggttcacgccattctcccgactcagtctcccgagtagctgggactacaggcacctgccaccacgcccggctaattttttgtatttttagtagagacggggtttcaccattcacaggatggtctggatctcctgacctcgtgatccgcccaccttggcctcccaaagtgctgggattacaggcgcgagccacagtgcctggcctctattgttattttcatagtgtaaacatccagaaaataaatgcttcggtaccctgaaaaatgtccagtttctgaaccactttctgagttgcaaaagcacagtaattcaagagttttaccaatttaatccaccgtgagctctcggccaacagtaatgtgaagtattttccaactacagtgatgttttctttaattcagaattcctgaagatcatttttatacttccaagcttgctaacttgagtcatcatggatttttccatactgtatttaaagcagtaatccccccaagaggggcaggtgatgagatcacctagcaggcctcatccaagtacagttttcccatccacaggacttcagtccccttccccactgagaatccctgcataggccacataaccccctatgactgggtgggaaaaaacactgagaaccacttatctaaagactgtcaacgtcacaagttgaaagacccctctttttgttgctgaattttatggaactgcaggcctcttgtcccagtagatgtggcagctggttccattctctcccaaacacacaggggaatgattagtagcaacgcacacaacctagagtgctgcaccaggtcctgcccttgccagttagttagtgagctcccttgccagttagttagtgagcacccttgccagttagttagtgagctcccttgccagttagtgagctccctgagccagttaggtagtgagctccctgagccagttagttagtgagcgcccttgccagttagttagtgagctcccttagccagttagttagtgagctcccttgccagttagtgagctcccttagccagttagttagtgagctcccttagccagttagttagtgagcgcccttagccagttagttagtgagctccctgagccagttagttagtgagctcccttagccagttagttagtgagctcccttgccagttaattagtgagctcccttagccagttagttagtgagcgcccttagccagttagttagtgagctcccttgccagttagttagtgagctcccttagccagttaattagtgagctcccttagccagttagttagtgagcgcccttagccagttagttagtgagctcccttgccagttaattagtgagctcccttagccagttagttagtgagctcccttgccagttagttagtgagcgcccttgccagttagttagtgagcacccttgccagttagttagtgagcgcccttgccagttagttaagtgagcgcccttagccagttagatagtgagcgcccttagccagttagttagtgagcgcccttagccagttagttagtgagcgcccttgccagttagttagtgagcacccttgccagttagttagtgagctcccttagccagttagtgagctcccttagctagttagagagctcccttgccagttagttagtgagctcccttagccagttagttagtgagctcccttagccagttagtgagctcccttgccagttagttagtgagctcccttgccagttagttagtgagctcccttagtcagttagttagtgagcgcccttgccagttagtgagcgcccttgccagttagttagtgagctcccttagccagttagtgagctcccttgccagttagtgagcgcccttgccagttagttaagtgagcgcccttagccagttagatagtgagcgcccttagccagttagttagtgagcgcccttgccagttagttagtgagcacccttgccagttagttagtgagctcccttagccagttagtgagctcccttagttagttagtgagctcccttgccagttagttagtgagctcccttagccagttagttagtgagctcccttagccagttagtgagctcccttgccagttagtgagtgcccttgccagttagttaagtgagcgcccttagccagttagatagtgagcgcccttagccagttagttagtgagcgcccttgccagttagttagtgagcacccttgccagttagttagtgagctcccttagccagttagtgagctcccttagttagttagtgagctcccttgccagttagttagtgagctcccttagccagttagttagtgagctcccttagccagttagtgagctcccttgccagttagttagtgagctcccttgccagttagttagtgagctcccttagtcagttagttagtgagcgcccttgccagttagtgagcgcccttgccagttagttagtgagcgcccttgccagtcagtgagcgcccttgccagttagtgagcgcccttgccagttagttagtgagcgcccttgccagttagttagtgagctcccttagccagttagttagtgagctcccttgccagttagttagtgagctcccttagccagttagttagtgagcgcccttgccagttagttagttagctcccttagccagttagttagtgagctcccttgccagttagttagtgagctcccttgccagttagttagtgagctcccttagccagttagatagtgagcgcccttagccagttagtgagcgcccttgccagttagttagtgagcgcccttgccagttagttagtgagctcccttagccagttagtgagctcccttgccagttagttagtgagctcccttagccagttagttagtgagcgcccttgccagttagttaagtgagcgcccttagccagttagatagtgagcgcccttagccagttagtgagcgcccttgccagttagttagtgagcgcccttgccagttagttagtgagctcccttagccagttagtgagctcccttagctagttagagagctcccttgccagttagttagtgagctcccttagccagttagttagtgagctcccttagccagttagtgagctcccttgccagttagttagtgagctcccttgccagttagttagtgagctcccttagtcagttagttagtgagcgcccttgccagttagtgagcgcccttgccagttagtgagcgcccttgccagttagttagtgagcgcccttgccagttagtgagctcccttagccagttagttagtgagctcccttagccagttagtgagctcccttagccagttagttagtgagcgcccttgccagttagttaagtgagcgcccttagccagttagatagtgagcgcccttgccagttagttagtgagcgcccttgccagttagttagtgagctcccttagccagttagtgagctcccttagctagttagagagctcccttgccagttagttagtgagctcccttagccagttagttagtgagctcccttagccagttagtgagctcccttgccagttagtgagctcccttgccagttagttagtgagctcccttagtcagttagtgagtgcccttgccagttagttagtgagcgcccttgccagttagttagtgagcgcccttagccagttagttagctcccttagccagttagtgagctcccttagccagttagttagtgagcgcccttgccagtcagttagtgagcgcccttgccagtcagttagtgagctcccttagccagttagttagtgagctcccttgccagttagttagtgagctcccttagccagttagttagtgagctcccttagccagttagttagtgagctcccttagccagttagttagtgagtgcccttgccagttagttagtgagctcccttagccagttagttagagagctcccttgccagttagttaatgagctcccttagccagttagttagtgagcgcccttgacagttagttagtgagcgcccttgacagttagttagtgagctcccttagccagttagtgcccttgccagttagtgagtgcccttgccagttagcctagtgagtgcccttgccagttagttagcctagtgagttcccttgccagtttgttagcctagtgagtgcccttgccagttaacctagtgagttcccttgccagttagcctagtgagtttaatgaaaagctccacaaccagggacatgtctgatgattcattattgagtgcttctcgaagcctggccctgttctgggcactgcagtggacagaagacgtagcctcccttgtggagcctgccttctaggggggacgagaggcacagactaacctaacatatgagataaggacagtgctaggcagaaaatgaaccagggccaagagtgttagcacaggcgtgcacacgtgctgggacgacctggaagctgacagtgtgaggaggagcgagccaacatagctaggcggggacgcgctgggagcagagagtcaacggcaggagcaagtctggtctgttagagcaacagagacagagcgcccctgaagccgacttatctgtacagacctgtgtggccaatactgagggacatcaggaagcaggggttaggacctgggatttgggggtgaagctagaccagagaagagcacatccagagaaccacaatctggctcacaccccctgggggcctcaggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggtgggtgtctgccacagcacttactgcagctcttcgtttagcacagggattcttcacctgacattctcggcagaattcagagggtctgcagatttttcactcaaattgaaattttgcattttcttttatgaatataggaagcaaacatctagtattggcaggacctgtttgtacccagtagagtcactttatttatttatttatttaaagacagggtttcactctgtcacccaggctgcagtgcagtagcacaatcatagctcactgcaaacctcaaactcctgggttcaagcgatcctcttgcctcagcctcccaagtagctgggaccacatgtgcgtgccaccacacccagctaatcagatatttttatatcacatcagttgttacagatatctcgaaatataatttatgctcattactacttggacctgccattagaggtcttgtcactgtgtaaagaaagaaacaggccgggcacagtggctcacacctgtaatcccagcactttgggagggcgaggcgggtggatcacctgaggtcaggagttcgagaccagcctggccaacatggtgaaacctcgtctctactaaaaatacaaaaaatttagctgggcacagtggcagtcgcctgtagtcccagctacttgggaggctgaggcaggagaatggcgtgaacccgggaggtggagcttgccgtgagccgagatgtcgccactgcactctagcctgggtaatagagccagactccgtctcaaaaacaaaaaacaaaacaaaacaaattagccaggtatggtggtgcgtgcttgtaatcccagctactcgggaggctgaggcaggagaatcgcttgaagccgggaggtggaggttgtggtgagctgagattgtgccactgcactccagtctgggcaacagagcaagactctgcctcaaaaaaaaaagaaaaaagaaaaaagaaacagggccgggcatgatggtgcacacctgtaatcccagcactttgtgaggccaaggccagtggatagcttgaggccaggagttcgggaccagcctgggcaacatggcgaatacccatctctcaaaaagtaaaaaatgagccagtgtggtgatgtgcacctgtagttccagctgtttgggaggctgaggtgagaagatcccttgagcccaagatgtggaggctgcagtgagcagagatcacaccactgcactccagcctgggtaacagagcaagacactggttcaaaagacaaaaataaataaataaataaataaacacattagtctgtcaaaattttttctgaatattttgataactgtatttcagtattattggttcctttgtagtcctattttatttatttatttatttattttttatttttgaggcagaatctcgccctgttgcccaggctggagtgcagtggtgcgatttcagctcactgcaacctctgcctcccgggttcaaacgattctcctgcctcagcctcctgagtagctgggattacaggagcccgctaccacacccagcttatttttgtatttttagtagagatggggtttcaccatgttggccaggcttgtcttgaactcctgacctcgtgatccgcctgccttggcctcccaaagtgctgggattacaagcgtgagccactgcgcccagccgtattttattttatagattacaaaacattctgagaagggggtccacaggcttcactaaactgccaaagagatctgtggcacaagaagtttgagacccctactgataacacagaagagttccgggcctggaggttaacctaccggcataatcccagtcagaatccaacgcatgggaggcgtgttcacctgcactcagcaggtgtgtctgttctgactgtcccacctcccccgttcacgagcaccttcaaatcctcaccatctctaggagcaccagccaggttgtgctgtgtgtctgagacgtgtcacctttttttttttttttttgagacggagtctcacactgttgcccaggctggagtgtagtgcgtgatctcagctcactgcaaccttcgcctcttgggttcaagcaattctctgcctcagcctcccaaatagctgggattgcaggtgcccgccaccatgcccggctaattgttttgtgtttttagtagagacggggtttcaccatcttggccaggttggtattgaactcctgacctcgtgatccacccgcctcggtctctcaaagtgctaggattacaggtgtgagccactgcacctggcgtcaccttctgtcctgaaagtaaatttgttttaaccattcacttctccatacagaagttataaaggttcatgtattcaaacatgacattattctccttcatgcctttccttacaggaagataatagaaatattctcctctgctttcctccggtattcttatggttttacttgtgtacagtaggagatagacttctgtgttgatttttccacttacatagcaaattttctcattaccatttattgggcaatccccagtattttgaaatattctcatttccatctgtacaggcaattatctgcactctttgttcttttgctggattattttcttttttttgagatggagtctcactctcgcccaggctggagtgtggtggcacaatatcggctcactgcaacctccgcctctcgggttcaagtgattttcatgtctcagcctccagagtagctgggacaacaggcgcccaccaccacgcctggctaatttttgtatttttagtagcaatggggttcctctgtgttggccaggctggtcttgaactcctggcctcaagtgatatgcccaccttggcattacaggcatgagccactgtacccagcttctcccccttactttaaacaagaaaatatttaagcatttctttaaaaattttttttagtttgtatatatttagagggtacgagtgcagatttcttatgtgactgtgctgtggtgaagtctgagcttttacttcccatcacccaagtagtcagtggtgattttcaaccctcttctccccgccaccttttcaagtctctggtgtctgttatttccctctgttggtccatgtatacccactgtttagccaccacttatgagtgagaacatcggctgaggcaggaaggtcacttgaacccaggatgtcgagaccagcctgggcaacagagtgagaccccttctctacaaaaaaattaaaaatcaaagggttgtggtggcacatggctgtagtcccagctactcaggaggctgagacggaggcttgatgtcaggaggttgaggccaagtgagccgacatcacgccactgcactccagccagcatgggcaacagagtgagatggcgagaccctgtcttggaaaaaaaaagtgagaacatgcagtgtttgactttccattggtgagttgtttcacttgggataatggcccccggttcaatcgacgtcactgcaaaagacatgcttttttttttttttttttttttgacacagagtctcgctctttcatccaggctggagtgtagtggcgcaatctcatctcactgcaacctccgccccccaggttcaacgattttcctgcctcagcctcccaaagtgctgagattacaggcgtgagccaccgtgcgcggccgagttcattcttttttttatagcagagtagtgttccgtggtgtatttatggcactttttctttatccagtcctctgttgggggacgtttaggttgattccacgtgtttgctgttgtggatagcgctgtgataaacacacgagggcagggattgtttgatatgattccttttcctttgggtagaggcccagtagtgggattgctggatcgaatggtggttctattttcaggtctttgagaaatttccatactgttttccagaagggctgtactaatttgcattcccaccagcagtgtgtaagtgttcacttttctccacattcttgccagcatctattgttttttgacctttttttttttttttttgaggcagagtttcactgtgtcagccaggctggagtgcagtggcacgatctcggctcaccgcaacctccgcctcccgggttcaagtgattctcctgcctcagcctcctgagtagctgggattacaggcacacgccaccatgcccaactaatttttgtattttttttttttggtagagacagggttttcccatgttggtcaggctggtctcaaactgctgacctcgtgatccgcccacctcagcctcccaaagtgcttaaattacggtcatgagccaccgcgcctggccacttgactttttaataatagccattctgactcgcgtgaggtggtatctccttgtggttttaatttgcatttctctgatgattagtgatgttgaacattttttcatatgtttcttggccacttgtttttcttcttttgaaaaatgtttgtatccgttgcccacttttttaatgaggttattcatttctttcttgttgagttgtgtaagttcctcacagattctggataacagtcctttgtaggatgcataatatgcatatattttttcccaggctgtagactgtctgttgattgtttcttttgctgtgcagaagcttttttgtttaatgaagtcctgtttgtctgtttttggttttgctgtatttgcttttgagcacttagtcacaaattctttgtcttggcggacgtccagaggaattgctcctaggatctttatggtgtcaggtcttgggttcaggtcttgaatccaccagctgacatttagaatgaacttactggagtcctttttttttttttttcataactcctaacaagttttgattggaaagacatcgactttggaggttatttgggaggaattgacagcgtagctctgagtagcagttctggtgcccagggccagccttgggagtcacctcctccagttgtccgcaaggagttttgggccaggacagacatcactgccagcatgagcaggctgctgtctggcatctcactgatcattttccatcttgctggttggctccttagagccgcagtgctgagtacacatgtgtgctgtctgcgtacacacagaacaaaatccaatagcagtttaaaaaccatcacgatagggtctgggtgcccggaattcagttctgatgggcagtgagactgttcaccacccgccttccctcctttgcaggggaaagacgcctcagccttcgccgccaagatgagggggggcttctggccggcgctgaggatgaactggcgggtgtggacgccactacagttcatcaacatcaactacgtccctctgaaggtgagggccacggggctcagcctctgctaacattactttgtcagccttttccttccttccttccttcctctttcctccccccctccctcccctcttcttttctcttctcttctttctttggtagttttccgctagacttagtttcatccgtgtctagactcctcaactacccttggattttgcccatgaccctgaatcattgctagttcgggattcaggaagcaacagagaagggtgtcccgagtggtcgtctttgcctcttctgttcgttcagcaaattctcattaaaagcccccatgccagggatgcctatgagttttctagcctttgaaacattcccagtcccaggaatgtacatgcaggcaacttgaatctatgctcctgggttgcagtcctcaaacttggcccaaataaactctagttatacttagaaaaagaaggccgtcacagtagctcacacctgtaatcccatcactatggaaggctgaggtgggcaaatcacttgaagccaggagttcgagaccagcctggccaacatagcgaaaccccatctctactaaaaatacaaaaattagccaggcatggtggcaggtgcctgtagtcccagctactcaggtggctgaggcacaagaatcacttgaatccgggagacggaggttggagtgagctgagattgtgccactgcactctagcctgggcaacagagtaagaccctgtctcaaaaaataaataaaatgttaaaaagaaacaaagcattcgtggtccctgggctcatgaattacagctgagcctgaaggcaggcactgtgcggccatgggtcctgccgctggcctggaagagctgcctcacctgcagccatggcagccacacctgggcaaggggtgggcccatccaggtgcagagtgaaggccttctgggtaagctgagcctttccgctatcctgtgcatgaaggagctgctgtgggggctgagtcaaaggtgtcagattggggctgggctggtggtgtggaggctggagctccaggctctgccactgggatcaactgtctttatgcacagccagggtccccaggaccactcccacactgggaggatggggtgcagcaccccctgcagcatggcaggatacccccagatgctacaggaggaggcctggcagagcctgcaggggccacgtgcttccctcccccagaaggtatgccgcccatcagggttttttactggtactctgggcgggcatctctgcctgctgccccaaagctccagacccctagaaagacagcagctgtgtggagcctgcattgttggtgcaaacagtccaggcacagggcaggtggcccttctgggaaaggtgggtgccgtcccagcccaggctgctgctagggaggacctgaacaggcctgcagtggctggacctcagctgcagagggccttcctgcattagcaccggctctgagccctgcccaggagggaggaaaggaccagggtgacccccgagggagaggagggaggcggcccagtgtgtgcacactgcacacaccacaaacacaccaagaagcagcaggaaaccaggggtgcacacagacaggacaaagaggcagttcacccttagccaaagttgccaggagttaaagcaaaataaaaaaatttcctttggctttaacagtggcccttcccagagcaatttcagctctatggggctgaagccagattgccttgaagagtgggtgggaattattttaaaaatcacaagtctagaacatgctctcaaagtctgtgggggccaggcatggtggctcatgcctgtaatcccagaactttgagaggctgaggcagaaggatcactcaaagccaggagtttgagaccagtctgggcaacatagtgagaccccatctctattttataaaaatgaattttaaaaagtttgagagaaggtgagaagtgatggaagaaggctgggtggcagagggggttctgacactcagagatgcggccatggtgggtgcagacgtgaagctgcttgtgggatgggcaaacacgcatgtccagaaagagcagctctgcggggtcccctaaggagtcagggtggatgtgagcccccagcacactcacagtggtgcttggacagaggccctgccctctgtgatgagagaggagagagaaagtgacagctgagcggacaggagagtgggacatcctgcctcaagcccccacgtgcctctctggagggccaggggctgggactgagggcagaggaagtcaggcgggcattttaaggggatacaggaggggcaagtttggccatgtggaggatgggagagcatgctgactgcagagacaaagacctctgggcagagggggctggggcttgtccagctgtggtcagcatctggggaagtgagaaggcaggaaggataaaggattttccagggagtgtgactgaagaacagtaggctaaggaagctacagccatgggccactggttctcgggaatttagagaaggaagcagagacaactgagaagacagactggccgggaacacggaggatctgggatggaagaggggagagctgggaagccgcgcctctgagtagcgtgggggcagagtcgccatcctaggtgggtgcaggtgtatgcggaagcagcattcattcagcaagcgtttcctgagcagtgactgtgcgccatgctgctagactcggagacgcggcgattaaccagacacatgggctgctactttcatagcaccacgtgccagggagagactcagcactgggccagaggattctggggaagggtgaagctgctgagtcaccaaagcagggcagtgggatggtgatgggttagaggagggaaggtctggggcccctccgctgttcgtcagctgtgtcccctgaggagggtgcagccacctgcatgatggctggtcctggagtgagagaggctgaaccaggagctaaggtgtgcggtgaagggggcaaaaggagagtgacttggctttgggattcctgggccgctgtagcctgtgaacactgtaactaggggaccgtttttcttctccactcctctctgctaggggcctagcacagcgtttggtacgaacaaaggctcagtaaatgcagtaatggatgggtggttggaccagctgaccaacaaacgggtaaacaaatgaactgggtgactgaggctggataactggccacggcctcccgctgaccgtggcctgttggactgttcttttcggcagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaatggtgactttaatctctcagaacaattgctgttgctttgaaagacatgcatagccagatgttttttaaattttcgtgtgtgtggtacgatacataaaacacaaaatttaccatgcatctggtcgtggtggctcatgcctgtcatcccagtactttgggaggccgaggcaggaagattgcttgaggccaggaatttgagaccagcctgggcaacacagcgagacctcatttctacaagaaaaaaaaagaaatacatatatatacacacacacacacacacacacacacacatatatatgtatatatgtgtctatatatacacacacacacacacacacacatacactcctgggatatcttcctgccacagtctcccaagtagctaggattataagttcccacccagccatacctggctaattgttttcttttttttgtagagatggggtcttcctgtgttgcccaggctggtctttgaactcctgggattacaggtgggagcaactgcactgggctcttttttttttttttttttttttttgagacagagtcttgccccgttgcccaggctggagtgcaatggcgtgatctcagctcactgcaacctctgcctcctgggttcaagagatttctcctgcctcagcctcccgagtagctgggattacaggtgtgcaccaccatgcccggctaattttttgtatctttagtagagaaagggtttcgccatgttggctaggctggtctcgaacacctgacctcatgatttgcctgccttggcctccggaggtgctgggattacaggcttgagccaacattcccggccctctttccttttaataaaggctgacttttgattgtccttaagattctttaaagaaaataaaaataggctaggctcggtggctcacgcttgtaatcccagcactttgggaggctgggatcacttgaggcagatggatcacttgaggtcaggagttcaagaccagcctggccaacatagtgaaaccctatctctaccaaaaatataaaaaattagcggctgggcagagcggctcatgcctgtaatcccagcactttgggaggccaaggctggtggatcacgaggtcaagaaatcgaggccatcctggccaacctggtgaaaccttgtctctactaaaaatataaaaattagcagggcatgggcaaggcgcggtggctcatgcctgtaatcccagcactttgggaggccgaggcgggcggatcacgaggtcaggagatcgagaccatcctggctaacatggtgaaaccctgtctctactaaaaaaaatacaaaaaattagccgggcgtggtggcgggcgcctgtagtcccagctacttgggaggctgaggcggtagaatggcgtgaacctgggaggcagagcttgcagtgagccgagatcgtgccactgcactccaggctgggcaacagagtgagactccgtctcaaaaaaaaaaaaaaaaaaattagcagggcgtggtggcacgtgcctgtaatcacagctactcgggaggctgaggcaggagaaccgcttgaacctgggaggcagaggttgcagtgagccaagatcgctccactgcattccagcctggcgacagagaaagactccgtcttaaaaaaaaaaaaaaaaattagctgggtgtggtgatgcatgcctgtaatcccagctacttgggaggctgaggcaggaaaatcacttgaactgggaaggcagaggttgcagtgagccaagatcgtgccactgcaccccagcctgggcaacagagtgagactctgtctcaaaaaaataaataaataaaataaaaaataaaaatagggctgggtgcagcggctcacgcctgtaatcctagcactttttgaggccgaggcaggcggattacttgaggtcaggagtttgaaaccagcctggccaacatgatgaaaccccctctctactaagaaataataaaataaaaattaaaaacttaaaaggctgaacattgccgtgtgcgtggactgcattttgcctgtccgtctgtccgtcagtggctagactgtttccagctcctggatgccgtgaaggatgtggcggtgaagacagcggcactaatgcctgctcaagtcctgcttgccttgggttttcaaagaactgctctttcagttcagaatatttaaggtggggtcgttcccaaaggaagtttagggcatttgcaaaagtaacagatgctcctgcaattgatgcagaaggtgacaattctgactatccctctaacttgccacttcccagtgagtcccaccccctgccatgatggaggattaagaacctggatctcagaacagattctagattagaatccagagatgacagtactgacaccgcttagggctgctttgtgccggaactcttctgagagctgcagcagccctgagggaggtgccattgttttctctactccacatgtgggggatgcaagatgcctcagctagcaagagacagtcctgattcagaggcagtcagccaggtcttgagccaccatcttcaccacctcatcatagggcatcagagtgtcacggcaaggtcaagagaatttgctggagaagatttcacatcatgtatatggcttaccacagcccgcatccggtcagttcgctgaacacacctttacggagtgctgtcaggcacacaggggagagcagagaccaggagtttttagtttcacacacttaacagtcatcagaaaacaggctttttttttttttttttttttgagacagagtctcactctgttgcccaggctggagtgcggtggcatgatctcagctcactgcagcctcccgtttccaagtgattctcctggctcagcctcctgagtagctgggattaccagcgcgtgccactatgccctgctaattttttgtatttttagtagagatggggtttcaccatgttggccaggctggtctcgaactcctgacctcaagtgatccatccgcctgtctcggcctctcaaagtgctgggattatcgagcatgagccactgcgcccggcgtaaaaaatacattaaaaaaaaatattttctcctgggctggtcagtttccacacagaggaatcctttagttcttgtcagggcattgggggaaggatggtggtggtagctgagcagggaatgagcctagtggccaacattcttgtggctatctggaggaaaggggttagaggtcctactcttccttatgtgaactctgtataatcccatctttattactgcatccccaatctgagctatgcttggtgtcctgaaatccagaaccctcctgttcaagtcccctggaatggcctttctctagtgctccacggtgatgaaagtgagctattcccctgaacatgtgggggagaaacgaaatgtggaaggcaaccttttcctctaaatgctcctgctttcagccccacagctctcagacaggaggctaatgctgccaactcccagactcttccagactcactggattaaatgaacttgcttcctggtttccttccacataggcactggtgttccatattctcaggtcgataaagatctgatctccagctcttgaacttttgttaactgatttatctgctgtcatttcttcttatggattcaactatgtccttgtggattttcccttgttttttattttattttttgagatggagtcttgctctgtcacccaggctggagtgcagtagtgtgatctcagctcactgcagcttctgcctcctggattccagcgattctcctgcctcagcctcctgggtagctgggattacaggtatgtaccagctaatttttgtatttttagtagagatggggtttcaccatgttggccaggctggtctcaaactcctgatctcaggtgatctgcccgcctcggcctcccaaagtgctgggattacaggcatgagccactgagcctggctgattttcttttttttgagacagagtctctgtcacccaggctggagtgcagtggcaccatcctggctcactgcaacctctgcctcccaggttcaagcgattatccggccttaggctctcgagtagcagggactacaggcgcgcaccaccacgccaggcttttttgtatttcagtaaagacggggtttcaccatgttggtcaggctggtcttgatctcctaacctcgtgatccgcccacctcagcctcccaaagtgctgggattacaggcgtgaggcactgcgcccggcccaattttcctttatttttttgagacagagtctcgctctgtcgcccagtctggagtgcagtggcgcgatctcggctcactgcaagctccgcctcccgggttcacggcattctcctgcctcagcctccctagtagctgggactacaagcacccgccaccatgccctattttttttttttttttttgtattattagtagagacgggttttcaccgtgttagccaggatggtctcgagctcctgacctcgtgatccgctcacctaggcctcccaaagtgctgggattacaggcgtgagccaccacgcccggccttccttttatttttattttttaaatcttcctatcatttttagtaaatgacctggaagcagcagacccaactggaagcgtacaggttcaagaaagcctgtttaagcagaagtctcagtatttctgtggaaccattcagtttttttatttttatttttttgagacattgtttcactctgttgcccaggctggagtgcagtgaggcaatctcagctcactgcaacctccgcttcctgggttcaagcaactctcctgcctcagcctcctgagtagctggtattacaggctggagccaccgtgcccggctaatttttgtatttttagtagagaccgggtttcaccatgttggccaggctggtctcaaacttctgacctcaggtgatccgcctgtctcggcttcccaaagtgttgtgattacacgcgtgagccaccgagcccaggcccaagtgatttttaaatagcttaaatcagatcatgtcatttcccaattttaaaatgggcagagatggtccagcaatcccacttctgggtacagacgcaaaacaatcaatgaaagagagatctgcacgcagcactgttcacgctagcgaggagatggcaacagggcaagcgtccagcaatgggtaagcggtggggtcggtgcacgcaggcgtccagcaatgggtaagcggtggggtcggtccacccagggagcgctggtccccctggaaggaaacccaggctctaacgcggtccctctgaggaccctgctaggcgaaacgcgccggccatagaaagactgtcccgcaggagagggcggtgttcggcccggggtttgaggggtcgggaccaggaggagggacagcccggccgaacctgaacgcacttcaggccgcttgaacagcacacgcaggaactgcgccgacggaaaactttacttcgtgttccgccaccaaaaaaatatcgtttaaacaaacctgcggcagcttcccagctcccttaaaccaggatcccaagttctccgcgtctccgcccctgcacccagcctccggcctcggcaggcgcttccggtgcggaaccttctggaaagtaccgcgccgccctcccggcgtccccacaaccccgcccgcacctgcgcgcaccggcgctcgcgagcacaagtgacgggactggagcgtggcgcggcaggtggctccacgaaaacgccccttcgcgcaaggctgccccgcgtcctgccgcgccccaggaggcgggacttccgcccccgccgcccggaagcggcagccgggggaagcgtgttcctcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggtgcgcgcggggctgtttggggccggggtcgggatgggggtcagggcaggtgttaccgttgggatcgagatcgggaccaggtttaaggttgcgatcgggtcgggatctggggtcgccgtctgctttccccagcggaggagccgctttccggggccgctctgcgcggagggttccgggggcggctgacccttcccgccggcttctgtggccgagctccgtcgcgtcctcgcccttctccccgcccctgcgagtccgccctgggtgccatcgccggagcgcgggccggggcgaggctgaggtggaagccgggcctccttcaggggcgtttgcaggagcgcgcccgcgagctgcgtgcggttattgagcgtttgaaatatggctcgtgtgattcctgaagggaatgcttagtttacgtcaatttaaacttaacgcaagcagggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggtaggaggatcccttgagtccaggggtcccaggctgcacagtgtgagccgagatcccgccacttcactccagcctgagcaacagagcctgtctcaaaggaaaaaaaaaaaaagtagtgcaggtttttaacattagttatgtgttgaaatagtatttttagcatattgaattaaaagtatgatcgaaattcacctgtttctttttaatgttgctattagaaaatgtataatttcacatgttgctggcattctgtttctgtcggccaggactgctctagcggcaaggatggttttcccagtcctaactcctcattatactcagtactttgagaaagggggcacagaattatactactgtggttgcgttaggtactttatattagatttttatcttttgttaaccttatttcctctattattagcatcatacactaagcatggtgtatatatcaaaattaatgagccaaaataatatagattaattatagttattatattagtttataatacattactgttaactaaggttcatgtttcattgagatttcctcagcttttacctgctgttctgttctagggtcccacatgacaagtagtcttcatgcctccgtaggcatgttttggctgtgacaatttctcagacttgttttgatgatcatgagtgtttgaggcgtcctggtcaggggtttggtagaaggtccctcaattgagacttctctgaaggttttctcatgattagactggagttacattctttttccttcttttcttttttctttttccttgagacggagtttcgctcttgttgcccaggctggagtgcaatggtgcaatctcggctcactgcaacctccgcctcccgggttcaagcaattctcctgcctcagcctcccgagtagctgggattacaggcacgcgccattatgcccagctaattttgtatttttagtagagacggggtttctccatgtcggtcaggctggtcttgaactcccaaccttaggtgatcctcccacctcggcctcccaaagtgctgggattacaggcatgagccaccatgcccagcctgttatattcttttttaaaaatcagaattctgaaaaatcagaaattctgaatcaatattctgaatttcttaggtctttttaaggaaacagatttactctgccgttaaagaacttgaagtaggctgggtgcggtggctcacacctgtaatcccagcattttgagaggctgaggtgggcggatcacttgaggtcaggagttcgagaccagcctgaccaacacggtgacactctgtatttactaaaaatacaaaaaaattagccaggcatggtggcatgcacctgtagtcctagctacttgggaggctgaggcaggacaatcacttgagcccaggaggtggaggctgcagtgagcccagatcgtgccactgcactccagcctgggtgatagagtgaaactctgtctcaaaaaagaaaaaaaagaacttgaagtagaaccgggagctgagcccagcctttctcttttaagcaggtgttctgtatttgcttgtcatgtctggggagaagtgaattgggccttgtgggttgggaaagacttatacagacagaaggcatgagcaactacaggaaggtgctagaagacagcatgtttcttcttgagtctcacctgtccacacttgaaagttccagagcctcatctggtgaaatctccagcttcttcctggaggtctcatgcagtttacggcttcctgtctctgtgcctatagctcccaaatattttctctggctcagcctgactcccccatacctgccaatttgagtcttggcctggtttatgacaggcccccaggtcggcgtggcccaaacggagcccttgagtcaccaccgtgcccttccacagcttccttttccgccactgtctcagcgagtaaataccagcaggttcgacttttgctattcccagctctgccgcgttgaactttttttgttgctgttgagacagggtctcgctctgttgcccaggctggagtgcagtgcagtgcagtggcaagatcatggctccctcctaggctcaagcaattctcccacctcagcctcctgagtagccgggactacagctgtggaccaccttgcccggctaattttttaatgtttttgtagagacggggtccccctgtgttgcccaggctagtcttggactcctgggctccagtgatctgcccacctcggcctcccaaagtgctgggatccactctttttcagattccagcagctctggaacagaccttcataatgggaatgttttcttcctcactgagtgtttgtttatttatttattttctgaggcggagtctcactctgtcgcccagactggagtgcagtggcacgatctcggctctctgcaacctccgcctcccaggttcaagcgattctcctgcctcagcctcccaagtagctgggatcacaggcgtgtgccaccaagcccggctaatttttgtattttgagtagaggtgcaatttcaccatgttggccaggctagtgtcgaactcttgacctcagttgatctggccacctcagcctcccaaatgctgggattacacgtgtgagccactgcacccggcctgagggtctaaaatgtgcttagtatgactgaggacatgatgttttaattttatttaattttgcttaaattttgaattgaaacatcctcatagctagtggctgctgttgggcattgcagttctaggctctgctgaagcatcatggtcagggaggcccatcttggccccgtggacactttccgcctgcgccccgatagccgctgtcctctttcctagcctggcgttctccgtaaccacagttgcgtttggggtagtctgtctcctgctgttcactgtctgcctctcattagagaagaagatgcacagggctttgcttgtctgttttgctctccagcgcatcactcagaacagacctggcactagctttgtgggagggagagtggcggtatgctcagagaggcctccccagggctgtgccaagggccttgtcttctctccatgctcttcccaaatagtctgacaatttggaaataacatcttgtcagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtatgtggtgggttcagatcctctgtggaccctcgtggttatgtggccaggtgcatatctgctggcgccttggttatgtgactgggtgcaggtcctccgccgacccccttggtcagctttcttgaaagtgcttggggcactgggcctcctggggcccatgtccgagaccatcacccctgaatcacacattattaccagtaactgtcagctgaacttggacagaagacaagcttttcaaaatgtccttaccttggccgggcgcggtggctcacgcctgtaatcccagcactttgggaggccgaggcaggtggattacctgaggtcaggaattcgagaccagcctggccaacccggcaaaaccctgtctctactaaaagtacaaaaattagccaggtgcagtggtgggcgcctgtagtcccagctactcgggaagctgaggcaggagaatggtgtgaaccctggaggcggagcttgcagtgagctgagatcgcaccactgcactccagcctgggcgacagagcgagactccgtctcaaaaaaaaaaaaaatgtccttaccttggccaggcacggtggctcacgcctgtaatcccaacactttgggaggccgaggcaggtggatcacctgaggtcaggagttcgagaccagcctggccaacagggcgaaacctcgtcactactaaaagtacaaaaattagccgggtgcagtggcaggcacctgtaatcccagctactaaggaggctgagacaggagaattgcttgaccctgggaggtggaggttgcagtgagccaagattgcaccactgcactctagcctaggtaacagagtgagactccgtctcaaaaaaaaaaagcccttaacttttagcaaatgttggacagatcttgtttgcatgagaccaaatgcagtgcatatcccagcagtgattttatacctgcttgatgccttggaaagcggcgtggcttgtgccctcggctgctcacctggacctgctgccaaagacgcttctctgcggcctgtggcactcacaggcctgatgcctggcgtctgcttgtttgtttgttttgagacatagtcctgctctgttacccaggctggagtgcagtgacgtgatcttggcccgctgcaacctttgcctcctgggttcaagcaattctcctgcctcaggctcccaagtagctgggactacaggcacacgctgccactcccagctatttttttgtatttttagtagagacggggtttcaccgtgttagccaggatggtctctatctcctgaccttgtgatccacccgcctcggcctcccaaagtactgggattacaggcgtgagccaccacacccagcctaatttttttttttttttgtatttttagtagagatggggtttcaccatattggccaggctggtctcaaactcctgacctcgtaatccgcccgccttggcctcccaaagtgctagggtgacaggtgtgagccaccgcgcccggcctggcctctgcctcttaatgccctgttgaacaggcgggactgagcaacaggatcccgcctgtccccactggcagatgctgcatagacagcgtccaggagggtccttccaccttgtccttgtgtccctgtgcaggtggatctgtagaagaaatgcctgcctagagaaggaaatgcagggtgggctaaggtagagtttacattttgaaaagttcttcgaatgggatagtgcctgttcatgcacatactaaaagttcagatagtaaaaatgtgcagggctgtcctccacagacgccgccccccagtccccagagctgtcctggctgcttgtgcacaaagaaagtggagtgacagatgcaggtgtggctgcatccagtggcttcggccttcctgaggcgttttcacctggatgcaaaagctcacaagagaaaaggcatctgcactggtgtccggcccccacatagcagcttggggtgtttaggtcccgctgtgttggcctccgccatggcgcgtggttgggggcctgtgaggctcaggttttggacacagttgagtgagggtgacaaggggggacccagaaaccacccctgggccccaccaagcgccagccaccatccggtttgcttgctgctccattggtggaatcagatgcatgttttttcctgtatgggggtgaagacagttgagtgccggcccctctggcccaagcctcgggcgggcaggagccatcggctgagcttgctgagcttgctgcctgatcaggggtcgtgtttgcgggcggaggagggggtgtttgcgggcggaggagggggtgtttgagggtggaggagggcgtgtttgcgggcggaggagggggtgtttgagggtggaggagggggtgcaggtgcggcactcaggtgcctttcaccttccaggtcgggagcaggctgaactcactgggctccgcctggcaagcttggggttgaagtttaataaaatcgtccattcgtctatgacgcgcgccatagagaccaccgatatcatcagccggcacctgccaggtgagtgctgcgcgcggggcctccatgcttgcagcagtgggcggctcgtggcagggccccggcctgagctcctggccaccgggaggtcacagcatctccgccggcggggccgcctcacccagcgcttcgctgtgcttctctgcaggcgtctgcaaagtcagcacagatctgctgcgggaaggcgcccccatcgagccagacccgcccgtgtctcattggaagccggaagctgtggtaaaaacctccccggggggcagctgtgtcaccctcgccttccctgggcaaagcggccctgctgggctcaccatccaccacgtgcccggccgtcccacgggcttccccgggcggcgatggggtctgtcctcctgacacccgccctgcccgagcacttccgcactgacggctcctcactctgcccccagcagtattacgaagacggagcccggatcgaggccgccttccggaactacatccaccgcgcagatgccaggcaggaggaggacagttacgagatcttcatctgtcacgccaacgtcatccgctacatcgtgtgcaggtaggcagctgctgggctgggcgtggtctaaaataatttcagacttagagaaaagcatgaggaagaagccgagcgagaccctcctccactgccgatgccaccctagtcaggcctcaccagcccccgggcgtccacttcccgcgagtcctagtcagttacgcggtaggtggcgtgttacttggagcttctcataaggctgttttgggcaagggtggtgcagacagggagggacccctgtggtgtcctgggtggggtgcgtgctgggtggggggtcctgagtggggtgcgtgctgggtgggggtgtcctgggtggggtgtgtgctgggtggggggtcctgggtggggtgcgtgctgggtgggggtgtcctgggtggggtgcgtgctgggtgggggtgtcctgggtggggtgcgtgctgggtgggggtgtcctgggtggggtgcgtgctgggtggggggtcctgggtggggtgcgtgctgggtgggggtgtcctgggtggggtgcgtgctgggtggggggtcctgggtacggtgcatgctgggcgtccgcactgccctggttgttttccctttgtaattgaacgtcctgtttcccctcaaactcgaccaaccaccttctgcctccggctggatcccactggcagcatcccgccgctgttgtccgctggggattttgtgcttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaaatttgcctcttctctggatccattaggaaatgtgtgtgtgggctccgcagctgagggggccctcttgagtgtgacgagtcctgtggtgggaggacaggacggcactggtcagtgatgccgtgtgaggctgggccctggtctctgcccgtctgtcacctgggcctgtcaccagggctggggctgctgggagcaccatggtcaagagcagcagctcccagaaagtcgaggatgtacgggccgagattctcaagcttggctccagaccagatagagcttttctgggggttggagcctccgggtggtgtggcctcaggctaagtgagtacctgtttgctgtgagtcgttcgttgcctcctgtctgtgcttgtgaatgagccatatgggtggcttctatgctgccaccaccaccttgtgtgtccatgacacagtcaccccgaggtgacacaaatgctaaaaatgcacagaaataaccggggcgggagagtggagccgacctgagtccacacagtggtgagggccaggcacgtgcacctggacacgagaatatggctgtgctgttccggccggtgccgccaggcagccctgaggaggctcgggaagcagcgtgagggtggccatgcggcccactgagacagggcggtgggtggctcagaggcgatgaaggcaactccgagcttttccgcaaatgcgaattgtgcctaagaagtgcatgaagatgccacggcgggtagatcccatctccgttctttgctttcccagaaagggacctgttgcactaactggctgctccctgcttttatatgggaaaagcagaaattaaactgtgtttcctcgtaagaagtcagcgttgttctgatctgtgcaaatcttgagttggggttgggcccctgtcctaaagagggcaggtccccaagtgtgatggctccattcatgtcgatcccagtcatcgattcacgtcgatcccagccagatcttccccgagaagccccgactgaagacaggagcggctcggctgatgtgtaccccggccctgaggctgctctgagacttctgaggggctcagcctctgtttgtagaacagagccccctggcacagcctggcccagcctcttttaaggacagagtcccctggctctagcccagcccgtttttttttttttagacagaatctcgctctgtcacccaggctggagtgcagtggcgcgatctcagctcactgcaagctccgcctcccgggttcacgccattcttctgcctcagcctcccaagtagctgggactacaggtgcctgctatcacgcccagctaattttttgtatttttagtagagatggggtttcaccgtgttagctgggatggtctcgatctcctgaccttgtgatccacccgcctggcctcccaaagtgctgggattacaggtgtgagccaccatgcccggcctagctcagcccgttttaaggacagagccccctggctctaacgtgctctttctctctctctctctctccccagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacagtggctcacacctgtattcccagctactcaggaggccagggtgggaggatcacttgagctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttgcccaggctggagtgcagtggtgcgatctcggctcaccgcaacctctgcctcctgggttcaagtgattctcctgcctcagctcccgagtagctgggattacagtcgcccaccaccatacctggctaattttttgtatttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttttggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaggactagttgtgagtgtgttaaaagcgtggaacttcggccgggcgcggtggccacgcctgtaatcccagcacttcaggaggcccaggcaggtggatcatgaggtcgggagttcaagaccagcctgaccaacatgctgaaacctcgtctctactaaaaatacaaaaattagccaggtgtggcaggcgcctgtaatcccagctactcaggaggctgaggcaggagaatcgcttgaacccggaaggcggagcttgcagtgagccgagatcgctccactgcactccagcctgggccacagagcaagacaccatctaataagaaaaaaaaaaaaggaaacttgtgcagtgtgagaaacgatggtgtcaccagaaccctttgcacagtgtcctgtctccccgtggctgacgcctctgcccgcatcgcaccggctgcctgctcagaggacttccgccagtggcctgggccctttccaaatccctgaccaggacggcaaggctgaccaatggttgtggagacaacagccacagcaaccatacaccactgtctagaaatagtttgataagccagggacgcgccaacttcaaaaacaaataccaggcacgctcacgtttgacctcagacgggagcaaggctggcgaggaagcagtccgggatgctctaagtcagctacacagggcgcccacgccacagccccaacgctgggcctccagggatggggcagcgctgcagggctaagcctttgttctgcttagggccccggctcctctgtaaagtgggaaagcttggaggtgggagcagcgccagcacgcctggcactgaggcaatgctcagagcaggcgcaggtttgctgggcagcaaagctcatcacaaagtggaatgaccacacatcagctggccccaatgccctgcgcagcccacggccactcccatcgctcacgtcatagacgtgagtcgcactcatgtgaagatctggacagactacctggtctaaagggggaagtggatgggagaccacgagcagttttcaatggatcacaagaaaccagtgacccagagtcttcaaatccttctgcaaaaaaacaaacaaaacccaaaaggaaagaaaacctgattatgctgcttaagtcaaatctgaagtcaaggattttgaaaagttaagccacaaactcagtgtgtgactaattctttaagagcgtacagcaatgataaccaagtctacagcccttggtattcccaggcagcctccactccaagtcctaaccaggccctgcttatctgccaagatcagagagactgggtgtgctcggggtagtatgcccatagatgattacctaagtttcttgaatatgaaactttaaataatttttagtttctttttctagagtaaattcccagcaaactttttttttgagacatactctggctctgtcacctgggttggagtgcggtgccacagtctcggctcactacaacctccgctttccaggctcaagcgattctcatgtctcagcctcccaagtggctcgttctacaggtgtgcgtcactgcacctggctcatttttgcatttgtggtagagatgggtttcactatgctggctagactggtctcgagctcctggcctcaagtgatccgcccacctcggcatcccaaagcacatgagccactgtgcctggtagacttcccttctaaaatacctgctgttcaaagtggttcttccttaaatggccttttccagtcttctgcatgtgggacggacgtagattagcaaagtgaggatggctcccggtttggctggtagctggtgggggtctaatttctgaatgctggactcagggcaggtatggcgggggagaaggcagggaggggcaggcaggagactggggagtggggagctgacccataccagggcagcccccagggatcttcagtgtgcatgttgtgaacgcctgcgtggagggagccgcatgaggggaaggctgagggtgtctggactgggtgagttacaggggcccagcgacgtcaacgatggaaaccgtcccctggtttgggacagactgaagacttctcacatgttagtaacgatagcctctgtctggccaaagtgaaaactgcacaccagaagcctcaatgagactggtgggaaaggcaatgccaccagatggcggccagctgccaggggtcgccatgccgacgtttatcccaaagccttttctaaggagggagcacgggcgggaatctgcagctggagcagtcacagggtttccaaccacgacaaacacgcctgcaccccgcacgcacagccgggccccaatgagggtttccatcagcccttccctgggaaaactctgcaggcttctggaaacatccacacggctctggaggacctggctgtggtccctgccatggcgccgctggcactcccacggctggtacgcagcaccatggctgcttttacccagaaacgagcagcagactcaccgggcgcctccctcacagctgccaccacgctggagaagggcactttccaaccaaagccaccacagcaactgttaatgtcaccaaggtttcccactgccaagagcaacggtaaaatctgtgctcttttaacggatgccagaaaatctttcacaactgagtcaagaaaggggcttaaaaacagcgagcgaatctgagggcacccaggttgatggccgtccaaccaaaacagtgccgtgcgcctgggcacaagtgagggatccttccgaaagcttgcaattattaccacgcggttttgaagtaattcatttcattaagtgttttgtgaaggacataaccccccgggacacacgagaatgcctccgttgggactggaatcgctgcccacaaacaaacggagaaacagtcaaaggtggcctaagacctgggaaatcaggagcagtggtccacatacaaaatcagggccaaaacgttttactttccatttgaatttacaaccatatacagacaatatggtaagattttagagaaaacagatcatcactacgaatatccatattctgatttcttttgagaaccaaggtgccttttaaaatgcggctttttagaatagcatgtgttgtttctgtctgggatctagatcttgtctgctacaaaacaaatgaacacaccctgtgtaacaaaatcgaattttaacatttaaatcttgattccaatattcctgacctatctcttgtcatatgaaagaaagaagcctttttttaaaacaaagtttcaattcagaatttttacaaacaaaaacaatcctgcgtctacttaatatccctgtatatcctcaaaaagcaagttcaggaaatttaaaaatgatttataaaaggcactgaagttagcaaaagcattggtgggttttcattttggattaaacactggaaatgttcacagagaaacaactgtgtgagcagttgcccgtaacacccaggaagaaaccgacctccaggcagcacctcctgaacacctcagcggctcctcacacattccaaccacagaccttcattcaagtcaaggtgaaggctacagtcagcacggcaagaaaccaagatgggactcaaacctctaaatgcaacactctgcatacaggagatcccaactgaaatgagttccaaaataacggatacctttatcgtataatcatttatgctcaacaaagcctcaggataaatttgaaaacagaacaatgtatagactgtattactgctgcactggctcctgaatgaagcaggcggtgaaggctcacgtgctgaggaaacagggaacaccttggcgccgctgctgagctctgtgttgctcctggtatcactcccacgggctgcaagacttcccaagagaaaagctactttcatcttctgatcagtaatttaaatattccgaacaacccaaatcacaatggttgctgcaagtctgaggcgcgctcctggctccctgatccctgccgtccacctccctctgtctgaaccatgagacccacgggcgaaccaacaggcactctgccaccatcagatgccaccccccaacccaggaaaagacagggcggcaaatagttcatcttggtgagtgcaggttatcaaagggacatcggtgctcacgcctccgccaagcccctcctcatccacagcgtctgtcggatgaggtgagtacagggtaagtacagggctgcctgcctgcaactgcctcagcgccctttcctctgctatatttcagacctagaaattgccacctaaaaagtctaccattaccacatggatattttccagaaaattggtaactgagtttgctttcattaacttctaacttcttccaaaatatcagaaatctaagtgttatatagaacatttaaatcttctaaaattctcacaccctcaaagtgaggagtaataatttaatcagaatatattcctttttgacagtttagcaataaacatatgacccttccttctttaaaaatgaagaacaaaccgagagcccagcgccaagcctacagggcggcaagctcagccaggcgcgccatcctgcggagctggctcccgtgcacggggctgtagcgcccaggactgcccaggcctggctttgcggggttgcttccagccacgctgtttctccccggactgtagctgtgagggccactgagatctggcagctgagacttgaaccttcctttcaccgcgggactgggccaactgcggaaagcaagaaagaactgttagcagacgggcacaggcccggagatgaacagcaaaagtcggagaataatggccccagactcaggcacatgcgcccgggcggaggagaggcactggtgaaccctggcaccgcgggcacacacgcccgggtggaagagacgcactgctgaaccctggcaccgcgggcacacgcgcccgggcggaggagacacactgctgaaccctggcaccgtgggcacatgcgtctgggtggaggagaggcactgctgaaccctggcaccgcgggcactgggagagtcaagctcatgggggtttcccggagaatcctgtgtgatctgagtagaaaccctgctgcttccacccttctagccctcagcttgtcaggagctgacccgttcagcttttccacccaaccagagctctgtcctgtgtgcagagagccacaacacccaaatccacagcctggctgacgggcctgccagcgttgggaaaagccactgataggttcgcatgaagtggaactggaccctgcagaagtttccaaaagctgccctgcgggtgacaggctgtccgggccccacatacctctgtctgtccgagggtgagtagcacaggacagcactcttccatctgtgcacggccgggaactgatgggggtcgacgtctgcacattcaagagcggccaaaacatcctgatcgagttttgatggctcctctctagaaagcacaataaaagaagcaaaaacatctttggtaaaaacataaagacttctaaaataccactacttttttttttattttgagacggagtcttgctctgtcgcccaggctggaatgcagtggcgtgatctcggctcatcgcaagctccgcctcccgggttcaagcaattctctgcctcagcctcccgagtagctgggactacaggtgcctgccaccacgcccggctaattttttgtatttttattagagataggatttcaccatcttggtcaggctggtcttgaactcctgaccttgtgatccacccacctcggcctcccaaagtgctggaattacaggcgtgagccaccacacccagacaaatatcactacattttaaactcaagaacccagcacacaaaacaacagtgtgcaaggatcgatctggcctgagcagatggaaccagggaaccagcagcagcatgtcagggcattagctctgcagagggaggcatctcccaaggccagggaggcggatgcagactcgctgttctgtgatgagaagagcaggggccagggaggagtcgcctctgggtgcacgcctgcattctctatggtagcaggatccacccgctgttaaaatgcagttttgcatacttgcacccccagagggtgctcagtaccagaaggttagggacatttatcccctgttagattgagattgaccccaagatggcttttcttcctagaaggatttagaagagatcattcacaccactggcaggcacatccctagcaaataacagccaacactaggatcacccacggtccaaccagaggaagacccagaaagagcatctagaagctggactcagagacaggaactgaacgcacacggcaagtccacacaaaagcttgtgtggaggccgggtgcggtggctcacgcctgtgatcccaacactttgggaggccgaggcaggtggatcacgaggtcaggagttcgacaccagcctggccaatatggcgaaaccccatctctactaaaaatacaaaaatcagctagacgtggtggcaggcgcctgtaatcccagctactcaggaggctgaggcaggagaattggttgaacctgggaggtggaggttacagtgagctgtgatcgcaccactgcactccagcctaggcgacagagcaagactccatctgaaagaaaggagaggagaggagagtcgaggggatggggtggggggataggggagggggaggtgagggggagatgaggggaggggtaggggagggggagatgaggggaatgggagggtgggaggggagggggaggggaggggaaggtgagaggagggggaggggaggcaaggggagggggaggtgagggaagggggagggggaggtgagggaagggggagatgaggggagtggatgggtgggaggggaaggggagggggaggtgaggggagggggaggggggagggaaggtggggaaggaaagtgagtgcagagggcaacacactcctacccaaaaaggaagagccgcctggccggttccctggtgacctcgagctgatcctcgtgcctggggctgctgggactcaaggacattttagcgatcctggctgacatttcactttctgtcctcctgtggccattcccgagttggtctgcgggagaaggctctaacaagtctctttctactgcattgattcttgaagtcaggatctgatctttagtttttgtactttcatctggtgtcttggaaacgctacgtcctatattttgcaaattcagtttatcaaactcaacagtcaaatccgagacaggtggcagatgggcttcctccccacggggggcctttggtctcttgcccgccagggtcctgctgtgattcagaggatggcagagcccatttctgctgctgtgtggacctcccggctcggcggcttctatgaggtctgcctcctgctccaaggggaaggcgctgcacctcgtatgtccaaaagcaccgactgtgggcgggctgttatttcgagctgcattttgccgattttttatttcttccaagctcatgtcatcttcatctagaaacgccctcacggaaatggaattgctgcctgtgaggacaacaaggagcacttcagtgatgggaacgacaggaagccacggagctgctccgccccatccatgaccaactgccgtgaccccagcaacagcaactcttatacccaaaacctccccactccatccgcgaccaactgccgtgaccccagcaacagcaactcttgcatccaaaacctcctcatcagatttcaggatggaaaaccacccacacgactccctggaaaagggcaaacaggaccctccagacacaatcaggctgctggggccaggcacagaagctcacgcctgcaatcccagcactctgggaggccatggcaggggggtcgctggaccccaggagttcaagactgcctgggcaacatagcgaaaccccgttctctatagaaaaattagctgacatggtggcacgcacctgtagtctcagctatttgggaggctcaagtgggaggatcgcttgagcccaggagggggaggctgcagtgggctgtgactgcaccattgctttccatcctgtgccacagagtgagaccctatttcagacgaggagggaaataaagctgccaggctgacttttctttcaaaggcagggacatgaaaacgccaagggcagcccaggtgatgggcgagatgactgccctgcacccccagccaccctccagctccgatctgctgcgaccccaggggctccgagtgtcacagtgccccagaggatcccgaagatcgtccagaacaactccatgaagtaaccctgctgcgctttaggtgtgaagataacacagaagagctcccgggcgcagcactgtgcgacaggcaacagaaatgtcccgtttggtgttcacgatggtggccgcggccacaggaggatccagaacacttgagctgtggctcctgctacttaggaaatgcctcaactttatttaatatttactaattaaaatgtacatagtcacaagacaacactgtaaatgaggccgctttacagaagtgagttctgtgccaccatcagctacaacacagcaaggtcagacttcaatgattcctgtataacgacggcactgacgtcgctctagttctgtggttcagagtcacaggtcgtgactgttgaagattcactgcttcttagtttaatgtatgtcaatcattttcattttctatcattccagggagtttgttttataaatgaagtgtcttgcgggctaatggttctattatgaccttacacacacaaactcacacagacacacactcacacacacacacacacagtttaaactgtatatctgctttaatttgtattttagcagattcgaatctctagttattagcaaatttctgtttttttaaaaaaataaatagagacagagtctcactatgttgctcaagctgccttcgaactcctgggtttcagcaatccacccacgttggcctccctaagtgctgggattatagtgtgagccgccacgcccggccgctgggattgcaggcctgagctcccgtgcccggccatcgttgatgtttttatgaatcacttttagattttgtagattaacctcttccatcatgctctttccattcagtgcatctgtgctttggaagcactttgcatcgtggtgtctgatatgcaccgtgtgaagtgctttgcgtgtgcgtcctggtgtctgatatacaccgtgtgaagcgctctgcgtcctggtgtctcatatgcaccgtgtgaagcgctctgcgtcctggtgtctgatatgcaccgtgtgaagctctctgcatgctggtgtctgatgtgcaccgtgtgaagcgctttgcgtttgcgtcctggtgtctgatatacaccatgtgaagcgctctgcgtcctggtgtctgatatacaccgtgtgaagcgctctgcatcctggtgtctgatacgcaccgtgtgaagcgctctgcgtcctggtgtctgatacgcaccgtgtgaagtgctctgcatcctggtgtctgatacgcaccgtgtgaagcgctctgcatcctggtgtctgatacgcaccgtgtgaagctctctgcgtcctggtgtctgatacgcaccgtgtgaagctctctgcgtcctggtgtctgatacgcactgtgaagcgctctgcgtgctggtgtctgatacgcaccgtgtgaagctctctgcgtcctggtgtctgatatgcaccgtgtgaagctctctgcgtgctggtgtctgacatgcaccgtgtgaagctctctgagtgctggtgtctgatacgcaccgtgtgaagctctctgcatgctggtgtctgatatgcaccgtgtgaagcactgcgcgtcctggcgtctgatacgcaccgtgtgaagctctctgcgtcctggtgtctgatacgcaccgtgaagcgctctgcgtgctggtgtctgatacgcaccgtgtgaagctctctgcgtcctggtgtctgatatgcaccgtgtgaagctctctgcgtcctggtgtctgatatgcaccatgtgaagcactgcgcgtcctggtgtctgatatgcaccgtgtgaagctctctgcgtcctggtgtctgacgtgcaccatgtgaagccctctgcgtgctggtgtctgatatgcaccgtgtgaagcgctctgcatcctggtgtctgaaatgcaccgtgtgaagcgctctgcatcctggtgtctgatatgcaccgtgtgaagctctctgcgtcctggtgtctgaaatacactgtgtgaagcgctctgcgtcctggtgtctgatatgcactgtgtgaagcgctctgcgtcctggtgtctgatatgcaccgtgaagcgctctgcatgctggtgtctgatacgcaccgtgtgaagctctctgcgtcctggtgtctgatatgcaccgtgtgaagcactgcgcgtcctggtgtctgatatgcaccgtgtgaagctctctgcgtgctggtgtctgatatgcaccgtgtgaagctctctgcgtcctggtgtctgatatgcaccgtgtgaagcactgcgcgtcctggtgtctgatatgcaccgtgtgaagctctctgcgtcctggtgtctgacgtgcaccgtgtgaagctctctgcgtcctggtgtctgatatgcaccgtgtgaagcgctctgcgtcctggtgtctgacaggcaccgtgtgaagctctctgcgtcctggtgtctgatatgcaccgtgtgaagctctctgcgtgctggtgtctgatataccccgtgtgaagcactgcgcgtcctggtgtctgatatgcaccgtgtgaagctctctgcgtgctggtgcctgatatgcaccgtgtgaagcgctctgcatcctggtgtctgaaatgcaccgtgtgaagcactctgcatcctggtgtctgaaatgcaccgtgtgaagctctctgcgtcctggtgtctgaaatacactgtgtgaagcgctctgcgtcctggtgtctgatatgcactgtgtgaagcgctctgcgtcctggtgtctgatacgcaccgtgcaaggcgcttcgtgccctggtgtctgatatacaccagtattctgatgtgcactcgtctttttcctgaaaatataccaaatctaaaatatcaggctcagccaatggagttcagctattatgagttttgagaaaacggcacagaatgaaactatattagattttggataatgcaaacacaagcagaaacagcaatactgctcaaagcgatgccattatttttcatgtaccctccccgacacacaacccatttaacattaaccttcccagcactctagtggatcacgaggtcaggagttcgagaccagcctggtcaatacggtgaaaccgcatctccactaaaaaaaaaaaaaatacgaaaattagccaggcgtggtggcgggcgcctgtagtcccagctactcaggaggctgaggcagaagaatcgcttgaacccaggaggtggaggttgcagtgagccaagattgcgccactgcactccagcttgggtaacaaagagaggttccgtctcaaaaaatactaacctaagggaaagtaccagacctttacgttaaaaacaccaagagacgagaaacagatgtgcgcatcccgtcagaccccggccatggggggcccctcccagctgccacagccacgcctgcacatgcttaccagacgtggtggctttatctcggcaggaggcttcccgttctcctgtttcttgttgagcctttttgcctatttcctgctgtgtgagatattcttctagtctttgcaggccttcctgggaagacagatcaacaaaacagcccagaaattcccagtattcaacccagggataccccagctcatgagctagctccctgtaagaaacaaaacacaattaaccagctgtgaaaccagaaaaaatactcagaactacacagaaaaaagccactaaagcttcaagtaccaaagcaatgtctgcaatcatggttataattttcctttatccttaactggcagctgaaatcatacggtgcattttctgaaacagcacgcctcctcacaggtaagcaggacccggcacagctctcaggagccgtgaaccggctgcaggcaggaaggaggcctcagcccgacagaccctcacgccagcaacccaggtcacacagttcaactcccacagacggacgtgttcatgatcacggaacagccctgtgaacttgcccgtggttctagtcatggccaggcacacgaaagcctggaggtcctttctgggttccagttgtacacctgacactgggcacatattttgagaaaatattctaaacaattccacgaagctttatttgattacagcataatttagctttgtggctatggcctattttttcccaaggaatccatagcattatatggtaccttctataaaatattaaggttccttagaaacatgtcccagaaccaacaaggaattccaattagaaaaggaaaggaaggcactgcagacatcccccaggtctgggacgggactggcttaagctagaattccacaacatccacaaggaattagaccttcacgaaaaggaccaagtctcccagaaaagccttctggaaattggtactttgaagctgtgatttgaccttctgtcattaatcaaaatgcaaccaactgtgtgccccacgctgctgcggctcagcctttcagtaccttcccactctctcaaagcctctttccgggtccgacttcttgacgtggtgaaggaagcctgctttctctcgaggtggagttttccagagcttgcgaaaatcttctgcctatgaagaaaaaaaaatgtattgagccgtgtcaggcactgcgcccctcagctgcggaaacctgaagagccgtcgtcatcgcagtagctgcctgtctccgcacacccttccttctctccccttcactagcagatccctgggccacgtgcccacctgtggcatggctgagtggccgcacggctgcactctgacctgggggaggggaggcggtctcctttcttgcagccccgtctgggctgtgaggttcagaaccaggagggcccgagcacgaggcctcaccctgaggacagtggacggctcggagctgccaccccgacgcacatgtgacactgctcccatcgcaggagaagaaaccagatctttctcagtcactctccctagagctttatgctttatgcatctcacctaaccttacctgataccacctaattttggggccattttcttttttgttttggagacggagtctcgctctgtcgcccaggctggagtgcagtggtacgatctcggctcactgcaagctccacctccggggttcaggccattctcctgcctcagcctcccgagtagctgggactataggcgcccaccaccacgcccggctaattttttgtatttttagtagagacgggtttcaccgtgttagccaggatggtctcgatctcctgacctcgtgatccacccgcctcggcctcccaaagtgctgggatttcaggcatgcgtcccggcgcccggcctggagccgttttcatcgcaactgatttagaaagtttctagcacaggatggtgcgtgcaggtcagtgtgtgaagtattccaacaggagaaagaattgtcaactgtaaataaaaaagtgtacaacctttgacccagcaacaccaccattaaggatttctctgaacactggggatgagtagaacctggggctgaggcttccaggagagggacttgtctgagaggaagccagcgggggctgcagccacagggaaacgtggtcaggaggtggacgtgcagatggagctttcctagtcacaacgggcagcctcgctacaccagcaaggtgcctaggacgggccatcaacacagcaagaacagggcgacacgcgcacaggacggggctggcccagggaatgtctgctttgttgagacagtggctcccagcacatcggccctggtaagcaagccacagagccaagaacacacatttctctgacaaacgttctcatcaccaatcactggtggatggtttgagatgaggacaaccttggggctccacaggacatggtccctgagaccacgcacaaggcaacaggctggaacacccagcagcacagtatagggacagccaggcaccacttccagaagcttctacagcagctcaccttggctggactcaggggccctgcgaaggctctcagggtcagtaccgggtctctggggctgcctccatagcggctgacgtgagaggcctcagccgtctggtctggggaccacagctccccgatgactggagaagaagtctcttccgctctcaggaggggcacgtagtagtggcctgagggaggagacaggcactggctgcaggcttccgccccctccgcaggtcaggcctgggtgagcaggacggggatcacgcgagcccttgccaaggcctctgcaaatggatccaacagacggggcagagggtggtttccgccagagctcactgcacttaatgcaaatggatacaatggaaacaaagtcacacaaggtctcagagctcacttcacttaaccagcctcattttcctccactgctacaagaaaagaaagaaaagaaaaggaagccccaggtagttaaaggactaaggggtcggacctgagtgaataagagtagcacacagtaggagcttaatacattttaaaaatgttatatttcattccagccgggtgcggtggctcacgcctgtaatcctaccactttggaaggctgaggtgtgtggatcacctgaggtcagaagttcaagaccagcctggccaacatgatgaaaccccatctctactaaaaatacaaaaattagccgggtgtggtggtgggtgcctgtaaccccagctactcatgaggctgaggcaggagaatcacttgaacctgggaggtggaggttgcagtgagccgagatcacgccactgcactccagcctgagcgacagagtgagaatctgtctcaaaaaaacaaaaaaaagtaatattttattccttctctcctttttttctcctcttagtttcagacagagtctcattctgtcacccaggctggagtgctgtggtgcaatcatggctcactgcagcctcgaactcccaggctcaagggatcctcccacctcagcctcttgagtagctgggaccacaggcatgcgccaccacacccggctaatttttactttttgtagagatggggtcttgctctgttgcccaggctggtctcgaactgctggatgcaagtgatcattccacctccacctccaaaagttctgggattacaggtgtgggccgctgtgcccagcctcctcgcttctcagtcctgcttctcttgtagtttatcacaggtgtgggctgctgtgcccggcctcctcgcttctcaatcctgcttctcaatcctgcttctcttgtagtttatcacaggtgtgggccgctgtgcccggcctcctcgcttctcagtcctgcttctcttgtactttacaatttgcatcactgaatacgcatctctcaacagatctggaatcacacggcacttggatgtgagtatggaaaaagcacaaggaagagtagtgtcttcaggtcccacgggacagcgcagtcaagccatataggatagtgtcgtgaggttctgtaggttgcacggaggccacacaccacctcgtcctgctttcaaacccagctcctggagacccagagtcaagaggcttcctt

SEQ ID NO: 795 - DNA, 314646 bp, Homo sapiens
ctctgtgagtgtaaaattgctagattaaaagccagtgtgcatggtcaagatactagatcaataggtacaacacaaacagaaaaaaatacaatgtaagtcaaactcatctatgtcttacagagaacaacaaatcaaattagttccttcaggaatatcacacaatactatttcttggtatttctctagcatttctttcctgataaattcagagcaacttacaaataaatattggactcaatcttatagtgtaattctgttaataaaacattctccatcctggagagtaagcactcacctattattgattagttacttctaataccagcagaactttgagatctctggaggagatactttgcttcatataaatcacattattataactaaatctttagcttccaacagtctgcttatcttcttggaagaggcaacttaacttccagacctagttactatgtttacagtattataccgaagaaccaatcccaggatttctctaatttccaactgtctaccctaaggcagaataaattttaatcccatttcaaagacaaaaaaaatgcaaagagaagaaaattattaggcccaagtcatataccagtgcctgagtcagagagattttctggtagagaaaatactgtcacgtcttaacacataccaataaaaggttgctattgttgttttaaccccaaacttccttgatgaaaagtatacaaaaaaactcaaagttcaggctgacattttattaactttgttcaaagaccctctaatattccacagtcccccaaaataaaaagacttatttcttatactgtgatattccaaatacattgctcatcaatccctaaagcacattacttaaccctaattcctatataacactaataaggggaaatcattgaataatatttgagtttttgaaatcaatgaataatatttgtccactcaataagcatttgttatacaccttgctgccaagctttatgctcaagtctcactcttgcacaataggatcattttttagtctaccaaatattagtactctttattagtactaccaagtataccaatgtgaaagaagctcctgtcctctccctcgtctccacaatcattttcaattcctgcatgtggtttcataagtaattatcttcttcttaatagtatgcatgtttattcatttcttaatttttttttattattatactttaagttttagggtacatgtgcacaatgtgcaggttagttacatatgtatacatgtgccatgctggtgcgctgcacccactaactcgtcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatttcttaatttttaaaaaactgtattatcttttgactacctacaatggaaaaaagattgatgtctctattactaccttcaccccaatcccaacttcctctcatagtacagccccatcgtcattctcttacaacttttttttttttaacattcaatgtggtaggagagggatctagaaatcctgtagctcctcattcaagtttctaattcatcctcctgttttcaactctaggcttcaaaggtaccaggtgcctctgattcctcaacttaaccaacttctctgtcttactgcttctttcagatgagtactggctttccctgctccactaaatcagttaccactgaccatctagttccagatttaaaattttggcttatatctttgctgcagtctactagtctgttcttttgctcttgttggcttatggctttttaaaaaaattcctgtatttttagtggtatatggggagagagtgataaaacataagcaaatgaaatgcttttgatatgcaatgtttaaccagaaaaccttaatattttcaaatacaagttttaccagaattgtattatttgatcctaacaacaattgcaaaggtaggcaggcaaacaaagtattatgtgataaatgaatgagcaatatcatcctcaccttacagataaggaaatgggatcagagacacagttttagtaacttgtcaagagctaaatagcttattagtagcaaaataaagaccagggcttacattttctcgtatctaataatcttctgcaggatgcattcaaaataaatggttggaattaaggatatcctcacggtggctcatcataaagtatacacagtcatgtccagaactacaggacccattcacattcaaaagttttagcagaatatatataacctaagcacaaatctaaatccttcttgccaaaggatgctgattattttcactttcattaatcctatttctccaaggagcaacttctggtatctggcccattgtgagtttaatacaatgcattctgaacaaactaactctcattagttctggagtatgacacaaagacaaaaaaagtataaaatacatacatatatatatatgcatactatgacatgttactttaaaatttttaagataattttttcagacttggcaaaatgatcatgcaacttgtctgagaaaaaaaatacaatcacagccatacaaaaatactggaaaagaaaacaaaaaatgagaaagaaccagcttcatcaaacattgaaagatatcatatgagaacacatggatggggacaacacacactggggcctgttggagtggaggatgcagggggagggagagctaatggatgctgggcttattacctaggtactgggttgatctgtgcagcaaaccaccatggcacatgtttacctatgtaacaaacctgcacatcctgtacatgaatccctgagcttaaaagttgaagaaaataaaactatagtaattaaaacaatttgagtctaggaagagacatgatacatatggaaatgtagtttaccataaggttgtgctaaaccaatgcaggtgacagagtttcatgaatgatgatggactagccgactactgtaagaaagatcaaaactagacccttaatttcgattaaataaattttatagaagtctaagatttgagcctagaagatgggaatagaagttttcaaaggtggcacaggtgaatttatttataaacttggagtgaggaagttccagaagttagaaaaagaaaaagattaataaatttagctgcatgaaaattcaaacttttcatttggaaaaaataccataaaattaaaaaattaactgttaatgaatgtttaggatatgcataggctaattcaattttcatttattcattcattaaatatctgagtgtctattatgagccaggcttgcatctacatgataggctatagtagtgaacaagatagatgagatctttgctcctttagagtttatattctagagaaaggaaacccataaacaagtgagaaaaatatccaacaataatcccaggcagaggattaaaacacactgatgtgagattcagtggttcagtgactattttaggctgagactcaggaaatgtcccagaaagtgggtaaggacttcacataaaccaataaggaaaaaacaaccaaaaagaaaaagggccaagggataggaacaggcagttcacagataaactacaggttgcctgtcagttcaaaatggtcattatcttcactcaaaatcaaagaaatattaaaacgatgagataaagtgtttctattgtattgacgaaaatcagaaaagtttgacagaaaacactctggtatagcatctaaattagtgaaacctaatttagtttttggaagtcaatttagcaataagcatcaaaacgtaagacgtatacatctcttgcagaagtgttcaaagatgtatgtatatgaatattcacagttatattattgaaactgtaaaagttcagggaaacatgttaatgcccaccaacaaaacacttgtaccataagtgagaccatcagcgcaatggaatacaatggaacagttacaaagactaagatggatgttttgtaaggtagagcaggggcctatggagagatctctaagatacattaagtgataaaagataggttcagagccgttttcttaggacgcttctatataaatagaaaatatatacatacattcattttgacttttatatgctgatgtgtatccaaaacatttaatgaaaaactacacaagaaaatgttaactgtaattaacactgggtagcggcgcttgaagtgtgaatgggcaagaaaaggatgctttactatcttacatagtttttgttttttaacttctgaaccatgtgtatatattatttcctcataccatcagtaggaatttattatcagtgtgagaggccatttctgttttcttatgctttcctttatttaaaaatcccaataaatatgtaatttttaacacagagagatataaaagagcgaaacaccacacatgaagctaagaactgttagggaggaagaaaagacgggaagagagcaacatacatcatcctattacggaggcaaggaaaggggagaagagataaagaccaggagggaaacgcggacgggagctgatgaggcatcaccatgcaagaacattgctccagatggccgaagggaaggtgctggcatcgctgcactcaggattattatcctataactagcaaagcatatttactaaggagaggctggtttttcttccgtactaagaaggataatttcagctaattaatttgttctgctgaactgacagccaccgaggatgtgtctgcatgccttataagcatattcttggttcatttactgagatcccacagagaagttcaatatctagagttaagcaaataaaaaataagttgttcttgtttcaaggaccaagctcgggacatgaaaagcatcaaagtgctctaagcaggaggacaatgacatgcaacatctgaggcattgttaaggcctggcctactcaatgcatattgtcacacgccaaccattttccagatacctaggttcatgctaaaggtacagatatcagcacagctccaccctgaaataaatcacagtataatgaggcagacacacccagaaacaactctgacacagggcaaaaagaaatgagttgctaaacacaaaattaagctacatgacatgggaatacaaggaaggaatgcaaacaggagaagggtgttcaacactttgtgtttgtgcacatcttatcactgtgctatgcaaatctctacattcatacagagctgcatacaaacgagggtaggttggtgatatgataaacaaaataccatcctagagattgaaagtatggaacttcctacaaacattggccaagtggtatgtggtaaatgaggacaacactgcaaatagcgccactgcctgtggccacccgatgcagtgctcacccaggagggctgctctgctggggagctgcaggatggcaccaatagctctgcttcgagcccaggtcaataataagaagaggggttgccatttccagcaagaggttgcaaacatcatttctctgggctccaattgtctgatggtgccctgttctacagaagggtcaactatacaacagacaggtgtgtgtaaagctggatgcttaagaaatgtgacaaggttagagggaaaacatgctccaaagcaaagtttcagtgtggtaattgaagatgaacatggggtcattttaaaaccatgtctgaatcccaacagagcatgttccgacatggttcagcttgactgctttatgtaaacatgaaaatgccatcgcctggcaaaacaaacttctcccaggagagcctgttctctcaacacaacaagaggaaagggatagtggaagcaggagagttgagaccatgaagtcatgaagttcaagaatgccttcctttgaaggtttaatacagaaaagctttcgggggaaggaggagagtttaaagaagtcctggttctccggcatccacagtaatacctttgccttgaaggagaaagatggccttggctatcaagaatggggagaaaaggcagaagctaccacccaaaattttcagagcaccaaccaaatcaaaggaaataaatactaatgggtgaagtagagtttaaaaataacacaagtaatgtacactctccccttactattgtttttaatttttaattttttaattgacagtttgtacatatttataggatacaatttgatattttgatacatatgtatgttgtaaaatgatcaaatcagggcacttagtgtgtccatgatctcatgcatttatcatttatttgtagtgagaatattccaaagcctcttatctagctattttgtaaggtacactatcatcttactgtcaaccacagtcactccactgtataacagaacatcaaaacatattcctcttatctaattgtaactttgtatttgctgttgctagttctatcattttaacagagagagaaataaacttccagctacaacaatcatggaatcacagctctatgtctcccacctaaaaatatttcctacacaaaatgcaaggtagacgtaggtttcaaaacttatctgcactctattttatgatctttgttttcattttcatatatgtgagcatatttctattatgttattaaaatgtggtagtaattgctgcatggtatttattccaaactccaaaaccttcaaatcctgtatcactgaacaaactgtttcaaatttcccattaatcttatgttaaaaataaacaaccttgtacaaatatcttgtctgtatctctcattatttcctcagaataaatgtatacctttagatctaatatttttacttttaggaaactcttcagaatttgatgttgccaaagtgcctctcagtttatcctctcaccagtaatagtacttcagtgtttgtggtatatattgacgtctactagtggaagttctccttaccccaacaaatacacaaattattattcatatttttctaaagtttaaatttcattatttttctctcagttgaaatttagaaacagtattttcaaattacctcaaattccattgaaatttattactagaatttcattaaacttacaagtaaacttggatagaactatagttactgaaatattgagttttagcattcgggaacattagccatctctgctttattcgaattgacttttatgtataataaccaaaacagcgtggtactggcatacaaaccaatggaacagaatagagagtccaaaaatacatccacacatgcagagccaactgatttttggcaaaagggccaagaacataggggaaaggacagtctcctcaataaacagtagtgggaaaactgaatatccacatgcagaaggatgaaattaaacccttttctctcatcacatacaaaaaacaactcaatttgacagttttcacaaaaggcgttaaaaaataatcaactcaaaatggattaaagactttaaatgtaaaacctgaaactaggaaagtactagaagagaatatgggggaagctgggcacagtggttcatgcctgtaatccccaccctttgggaggccgaggcaggcagatcactgcaggctaggagtttgagaccagcctggccaatatggcaaagccccgtctctactgaaaatacaaaaattagccaggcacggtggcacacacctgtaatcccagatacttgggaggctgagtcatgagaattgtttgaatcccaaaggcagaggccgcagtgagccgagatggtgccactgcactccagcctgggtgacagagagactctgttatgaaaaaaaaaaaaaaaaaaaggaaaagaaaatgtagtggaaaagctccatgacattggtctgggcaaggattttttggataagactttaaaaggacaagcaacaaaagcaaaaacagacaaatgagattacatcaaactaaaaagcttctccacatcaaaggaaacaatcagcagactaaagagacaatctacagaatgggagaaaatatctgtaaactatacatctaatagggggtcagtatccaaaacacataaggtactcaaacaactcaatagcaagagaacaaataacctaatttttaaaattagcaaaaagggccaggcgcagtggctcatgcctataatcccagcactttgggaggcctaggcaggtggatcacctgaggtcaggagttcaagatcagcctgatcaacatggtgaaaccctgtctcgactaaaaatacaaaaaaaaaaaaaaaatagctgggtgtggtggtgggcgcctgtaatcccagctactcaggaggctgaggcaggagaatctcttgaaaacaagaggcagagtttgcagtgtgccaagatcatgccattgcactccagcctgggcaacaagagcgaaactccatctcaaaaataataacaatttaaaaaataggcaaaaggcctgtgtagctatttcttgaaagaaaacatgcaaatggccaacaggtatatgaaaaaatgctcaacatgactaaccatcaggaaaatgcaaactaaaaccacgatgagctattatctcacccccattacaaggctatcatcaaaaaggacaaaagataacaagcgatggcaagaatatggagaaaagggaacccttacacgctgcttgtggggggtgtaaattagtacagccattatgaaaagaggtgtaagttctctcaaaaaattaaaaatagaagtaccatatgatccagcaatcccactactgggtgtctatccaaaggaaataaaacaagtatgtcaaagagatatctgcacccccatgtttattgcagtactgttcacaatagccaagatatggaatcaacctaagtgtccatcaatggataaagaaaatgtgggatatacacacaatggaatattattccaccataaaaagaaggaaatcttgtcatttgcaacaacatggatgaacccagaggacattatgttaaatgaaataagccaggcacagaaagacaaataccacatgatatcatttatatatggactttaaaaagctgatctcatagaaatagagtagaatcatggttaccagaggctgggggggttaggaggaaatggtgaagtacagggagatattggtcaaaggatatgtaattacagttagatatagggaataaattcaagagatctattgtacagcaaggttaatgacagttgtaattaatgacaataaataatgatcatttattatattcttgaaaatgcaaagaatgttaagtgctctcaccacaaaaatagtaactgtgaggtaatgcatttgttaattagctagacttagccatttcacaatgtttatatacttcaaaatatcatattgaacattataaacacaaataatgttttctgtcaattaaaattggattttgtggattccaggaaagtttttaattttttttagttgttgaacaattatttatatagctgctttttgattagatctttttgtcccataacgtattttctaattaagttttgcttgtatttgagaaagttgttgattcttgtatatattttttaaccaaatctttttttttttttttttttttggaacagagtttcgctcttgttgcccagggtagggtgcaatggtgcagtcttggcttactgcaacctccggctcctgggttcaagtgatttgcatgcctcagcctcccgagtaactagaattacaggcacctgccaccacacctggctaagttttagtagagatggggtttcaccatgttggccaggctggtctcgaactcctgacctcaggtgatcctcctgcctcggcctcccaaagttctgggattacagaagtgagccaccgcgcctggtccaactctcttattaaactccatttgttctcattatttttcagttgattctcttagtttgcacaggcaaattgctcccatgcataaataacaacctacttccaataattagaaaagctcttttatttttagttttatcaagttggttaaaaaatatccaaaccttgttccattcagtaaaaacagggaatttttttttagttaaaaaaataagttttctatcaaataactttgagtagcatgaggttggaattcccagaataatactgggtaacaaccaagtttggtaggggttgcaaacatccttatgttgttcatagttttagtatttcaccactgaatataatgttggttattggtttagaagactacaagtatgttaagaaaatattatttttagttcactgaagtgttttttaattgatagtaaagattaaaatttatcaatgtctttttgtgtaactaaagagccaaatattcttgtcacatgacctatcctattgcagtgataagatataaaaagttttaatatatagctacttatctttgcattcctggaataaactctactttcctttggtaaattgctattaagagaaaaatttcatcagctagaattttccttcagatgttaatctctgtctttataagattggtctatctgtgagagagagagggagggagagagagagagtgtgtgtgtgtgtgtgtgtgcgcgcgcacgcgcgcacacgtgtgtgagtgtgcacatgcttcctttatcagattgtgacatcatggggatagtgaaataaacttctaaaatgtttcatcttttttcttactctgaaataatttgtaaagcatagggaaaaaaaatctgttccttgaaaatttgaaggaacttgcttctaaaattatccaagttcagcctcctgggggaagtaattctcagaaaacttcagaaatcacttgcattttcattggtctttatgagttttaattatgtgagtcattagagttatatattttcctagaaaatcattcacttaatccaaatttttaattcattagcatagcattgtttatagtaacataattttaaacttttccaaatctatggttctagtccctcatttctaatgccgtgtatttgcatttttactaatctcttcttgattagacttaccaaagatgtgtgcatttgttgaccttatcaaagaacaagctgttagatttttataacagctgtttcttagagttttattattaatttctgttcttatcttaattactttcttcaggatcatttattgtttttgttctaaattcgtagatcagatgcttaattcatttctttttttagtattgaatggattaaaatgttgtaattttgagtacagctttacatgacttccctataaaagtctctcactataattttgtatgtgttctataataataattttctctgtcacccaatagtttattttctgactttcagtattttactgattcttgtatatattttgactgtaaaatcaatgactttctaaatgactataaaaccaataaccatgcacaatcaataaatgcaatcagcttatcacatattttaagaagtttctgaaagagagaaaggagacaggttacattaccagggaaaaccaatgtgcaggataaattggagctaagtccacctgcttctgaaggagctccaggagggaatactgggacagtcatttagatgatcagttagaaaactgcactaagagcagcttggtggtgggttcttttccctcccacacttgcactacatagtaggcagcactatcatggcccataaggtaagaagtgaatgagagaggcatggctgggctcagggaaacagggcaacgtcccaagtacctactgactataagagaacacgagtctactccacacagaagacaagctcctacatacctcattcagcagcatatccaaatacatataagaataatcaaacatttgagaaagaattccatgggagataaagattaaaatggaaagaaaaaaacagttaatatggtaaatagaaaacttatgtttgtatagttacaaatatacaaacattaaataagatgagatgagaaagaatattgcacttacaaagcagaacactgctacttaccaaatcagcaatcttggtaaataaacatattcaatatgtgccaaataagcagaatgaaaagtcaagaaaaaatttagtgagcaggatgatctagctaaagctttcatccagaatccaattaaaaaaaaaaggccaaagggataagaagtacaagaaaacaatgaagttatatacagaacagatctgaaatgtccaaagtccatttgatagatgtcccagaaatggagagcaaagacaataagggtaaagagacataaaagaaaattaggaagaaaaaaggaaaagtgaagagagacatgtattttcagattaaaagagacaaccaaaggctatgcaagattagaaacaaaaatagaaacactgtgaaatttcttatagtacaggaagggggagtggagagaagaaaaaaaacagtaaataaataaaacagagaattcagtgtcagtaaaaaaaaagaaaactaataaaaagtaaatcatgcagtaagaatacaaatacatgcaaatatgctactaatcataataaatgagaacacatcaaatctacccattaagagattctgaaactaggtaaaaggaaaaccagacatttctttccactcaaaatctactttaaacaatgacacagagatgttaaaattaaatgattaaagaaatgtcatgtaaatactaaccaaaaaaaactggtagaggaattactagaatcagacaagatagtcaaaaaagaaatcaagctaaaaaatcattaaatacaaaaagtagtatacttcatattgataaaatctatcctaaaatgtaggcttcccttagtctcattggtcaaaactgtatcacatgtccacagagaaaccaatcacagtcaaggagaatggaattctcatgaagagttagaccactttgggaataaatccctggagctggggtagcacctgccttttctgaaacacagttcatgcaaagtaggatggatacttgaagaaaaatcagagctgtagagaagcaggcaatcaaaaatatttgacacatcactctgaaattatcacaacgcctaatttatttccttgcagcattagtattatggtttggctctgtgtccccagccaaacctcatgttgaattgtaatccccaatcttggggaagggacatgatgcaaggtgattagattgtggaggcggattgcctccctgctgttctcatgacagtgagttctcaggaaatatggttgtttaaaagtatatagcacatccccctttgctctctctcctgttggccatgtgaagatgtgcttgcttcccctttggcttctaccacgattctaagtttcctgaggcctccccagccatgttttctgtatagcctgtagaactgtgagccaattaaacctcttttctttataaattacccagtctcagatagttatttatagtaatgagataactgactaatacaattagttactacagattactacaaggtgatgaatcactataaaatttaaaagtataatgttgtatttctaagtctccttttaattgtttactcctcccttaaaatgtaaacttctggagagctggaaccttgtctatcctgatcttaattatagcttcatcaacttgcacaaggctcagtatataataggaactcaatacatgtttgccaatagaatgaatgaatgagtgctgggagagattactctgagacagatcaaccagaataatacagttaaaaaaaaaaataaaagccagagaaggaaagctttaaagtggtgttagtgttacagagttcagggagaagataggaattacaaaaagaccaccaaactgtatgttcagaagggattttacatttaggaagcaatttcagtgacagcatttgtgaatataaaccagatcataaggaattaaggatgaggtgggtaataaagaagtggttacagtaaaattacctttgtctttttttaaatttgctagaagcagaaaaggtaatatctctgaggatagcaaaatcaaggaaggggttagctggtttattttagaatggtaagatgagatgagaagttcacgtgtgctctatcatcttcttcatgacctactgtcaccaactgtggcatatttctgacaaaaaaaggaagcatccaatggagaagaatgtattgaagatatagaaaaaagaggaattacaaataagtttctagaagaaggaagtgaatcacaggtaaaatatttagagtttaaacttgaggaggctccttttgtccccagagccaagagtaattaaaaatgtgaaagtcagagagacacatagaacaaaacttatgtgctgtcacctaaacttaacctagattatttacctaagaattattccatagtaggtatccaataaatatttgcggaatgaatggaataaacaaacacataaatggatgcaatgattaaaatgtgttgtgttttgtatctttttacagtaaacatgatcctcctgttttcttaaggtaaatcattcaagtgataaggaatgaaaggttctacaaataaagaaatgcctttggccaggtgcggtggctcatgcctgtaatcccagcactttgggaggccaaggcaggtggatcatttgaggtcaggagttcgagaccagcctggccaacatggtgaaaccccatctctactaaaaatacaaaaattagctgggtgatagtggcatgcacctgtaatcccagctacttgggggctgaggcaggagaatcacttgagcctgggaggcggaggttgcagtgagccaagatcatgccactgcactccaatatgggtgacagagtgagacctggtctcaaaaaaagagaaatgccttcaatgaacgtttcccaacaacaacacgtcaggcaaaaaaagagagaagcaaaagtaaggtagaatagatggataagtatccttgtgtagtctactgttactgaaatccctaaggatggaattatttgtatattaaagctattaattttactgaaagctacagtaagttaaacgaaataatttatgtaaaaggatatataataaaaatatgttcaatcagtaaccagaaaatatgtgtatatcaatatttatctaagtctagaataaaaacaagattaagaaataaaaagtttaattttcactgtttaaaataactgctcaacctgaaaattaaatcccagatctagtatcctaatttgttaagcattctgtttgtcaaatgttctacttttaacagtttttatgttccaaatatatatgtcaaacttttaaaaacactatttaaaatccactagaagttatttaaaaataaatcatatctacaactgactttgcaacattcaccttagtatgctaagtacctcacaattttatgttaagttaaaagctcatagaagcaaatgaacacttttacgtcatttagcagacatcattaaaagtacaacatgactatgtaccagatttagcttctacttgttaactactagaatcttaccataacattgcctatttgattgtagatttcaagattaggatcttgccaagacaaaaagatatttatttaaaaaaaaaaaaaacactaagggataaaaatgtttcatgattcgtctttcttacacaggagctaaataagtaaatttacaactcgcatgatttctttcaatgatttaatgacaacctatggtgcccaaaacagcctagggacacatttataccatatgctgggcgaaactatgaatgagaaaggggttccacactgttgggaagaagatagcactcaaaagggtcaaattatagcaacactaatgaatacaaatagttcatttttcaatggaatttttacacacaattgttgtaataaattaccttgttggggaaagacaaagaaaacataaattaaaccaaatcaaggaaatcaaaatgggagttagaattctagttaattatagaactgaatatacagatttgagaaatgttctataagaaatagtgacaggatttgtcaaccactagtatgacaagaggaaaagttggaaaataataatgatgggaaagataaatcatttagttagctggagccccaccccactcccttttcttctcgtttaaaggatctgaaataaagtggcactttggagctaaccatgggtctttctcatcattctcatttcatgctgagcagcttctggcctattaaaagcaggtatgaacatcaagtatgccactgactattttcagttaccataccagaaatttcacattgtaatgaagattattctttaagcacttttcttagaaggctctgcattcacttcactgatttccattgctcaaaacatatggaatgcctcacatatttttatacccatgtagtgtaacttggttttactgtatgtgtataactatttttagtgaacatttatgccagtttcataactttgcatgcctactttcttatgcattatcacattctctggataccatctctaatttcatatatcttcggtttaaaaatagcagtgatggtggtggtgttttgttttgcagatgagaagttcaccagtgctctatcatcttcttggtgacctactggcaccaactacagcagatccactgtgcatccatgaggctaggtaccatgaaagttttgaccagaaggagccaccaccatactcttaaaacacatccagaaactcaccttttattttcaatgcttgtattcttgttttcaggattttcatgtgtctaaatatttctgttcagaaattcttcaaaattatctagtacctcaaataaacagttagcaataactagtaggggcttgtaagtaccttttgatgttgttcatccttcatcttttgcaattttctgttttcttctgcctttagagaatctctgtaagcccagcttctggcctgtaaaggtacaaagagaaaaaaaaaaaaaaaaacaacttgataggataaagggttgtcacagtacaccaagctgcctactataggcccggtgctaataactcaacctccgtactgagcatatagtaagctctccatacacacttggttattaagtgatttatgcatatgtctgaaaacgtcccttggaacatataaaaagaaaactagtgtaagcacaatcatcctgcacatttgaaaggatgatctaaatgtttaattaagctttaaaaatatcccctcagagataatcaacatagtttattccttctagtggaaagtttaggacattttcaagaatattccgactagctgatcagtcaatattaaagacaagcaatagtggcactgtctttagaagaacgggcatgtctactgctcattaatgatatctgattaagcagcttgtcaactagtggttgataccatataatttcaaggatgcatattttctaagcacttgcatccctaatctggatgaagttttatttctacctctgaaaaggaaaacaaagcctattcaggaacacatgacaacaaagcctttggcaagccagcacatgagggagaatgcccttcggtgtctctgacccaccacaccagagttccacaccctggcatagtgaccatgtgttctgacatttatggcatttcaagtgttctgtttatttgtcatatgctttctctccttcacattgatttgcagccccagcttctgtaaggcaaagagctaatgcttaggaaattacatggatctcataaaaaactatcagcagcttcatggcagcaggttacatatttcagacctagttctcaggactaataatccataaagttcaggtaggctggttccccctttttccagcctacgtgaacttttatgtaacttttctcaagcacttcttagttcattctggcatttctgtcactataaaaacccatatcccatcaaataataagaaccacttcccagaaaaagagagaagctttcaaaatggtatcatctatggcagtgccagttagaaaactggagcttcctgtgttcagaaatccctggtttatccaaaccctgctgcattgggcaggtaaacatacatcatatgactttctcttatttgcatcctaaactcaaggggactgtgctaagacatagaaggggaaaagtgattctctgacaagcctttctttttatctctgacaaccccttctttttatattagagaaggctagcctttatcacaaatattccatataagacctagtgaggaagggaagaagggagggagggaaggagggtgagaagagaggacaggaaggaaggaaaggagagaagaagaaaggaaagaagacagcttctactcaagatattaaaaggtagaataaaatatttagttaaagcaaaattacaacttgaatgagagtatctaaattctatttgaatagcctccctttaaacttgtcattttgttgttcttttattagaatacatgtcttagtttttgactcagaaaaaagtggttattaaataccttattattaaataaggtgccttataaaggtccacagaaactgggaagtcacatggcatccaaacttatgaaaagttcagttacttgcaatcctaatgtttgcttacccagctgtgatccctaggcaggataggaagtttctgttcaaaaataatagaagggaataaattgatcactatttttcttagctctaaacaccagaaatttctaagtcactgtattcacataatttgtctaacattgaaatattcatttaatacaataccaatgctatattttatcattcaaccaaaatacacctttatttatcctccccaaaagctatgcttataatgtactcattctattaacagtgtttaaggctcctctgtgcaagcactgtgtcaggacacgatcccaggcctcaagcatttacagcttagtgtgaaagtcaaacgagaagactaatggttacagtacagcatgataggtgatatgatagaggaagccaaaaagaaggatatttaattaaactagattgaggagactttccaaatcaagtaaggctaagttatatttcaaagagtgagtaggaatcagactataccgggagaagagcatcacatgagcaaatggaaaatagcagtgcatgagtttgctagggcttccataacaaagtattgtgatactggtggcttaaagaacagaaatttactatcttatagttctggaggctagaagtccaaaatcaaggtgtcttcagggttggttccttctgagggctatgtgagaaatatcttttccaggcttctctttttggcctgcagactccatcttcatcatgcatctcttcacatcatctcccttgtatgcatgcttctgtgtcccgatttcccctttttataaagacacttttcataatgaatttgaacccactctaggagcctcattttaacttatttcctctgtaaagatgctatctctgaataaggtcacattctgaggtgctaggggtcagggcttccacataaattttgagaagtgtgggtctcaacccatgacaagcattaagttctcctttcaagatggtggagtaaagatgttcctgttccattctccccaaaattaccctaaacaaagcagaaaatgaaatacacacaagctctatcttccaaaaccaagagatccatattcacagagggaaatctatgaagaccaagtagataaagaaacagtaagtgacttacagaggaaaagagcaaacctgaagacttgctggaaggggctagaggacacctatggggagccagttctctccacagagcaacatgagggcccaagaaatggatgcaccagctattgaggaagacagatggataataggcaggtaaaaaggaaggaattactagatagtctcagtagaagcccttcacccccatatacctgctcctgctttgaaaatgcaggtgctaattcaccaaacaccaacaggaaatgaaaagtgtattttctggataaactaaaccaggcatatgtgtaaagacagcagcagtggacaaatgccaggctgagaatgaaatgactctataaagtcctgcatactgaccagtgagcctctgagtccctctctttgaagtttttttctgcttcctgtactgtttcttctgagaagtaagaagtgatatatatatttttaaagtaacaaagaaaaaaggaggagtttggagacatttttttaaatctccccttcttccccccaaaaaaaccaaatcagtaaaatatttagaagataaagtcaagaaaatatgccaaaatatagaaaaaaggtagtcacagataacttacaggagaaaatctctaaagttagaagataaatccgggaggtctacaatttgaataatagaaattccataaagagaaaatgaaaggatataagtcagagataacacaagaaaatcatctagaactagagatgaatttccagaccgaaaatgaattaaaaaaagactttcacactaaatcacatcattacagaatgccagaaaaagaaaagatgatattaaaatattttcaggggaaacagagaaaatccttcatataaagcctgaaattcaaatggccttggatttctcaggaaccagtattcaaagttagaagagcaatgcctcaaaattctggaggaaaattatttccagtttggaatagtcatcaataaaaatgcaagcaaagtatgagagctgaataaagatagtttcagacatggaaggacctgaacatgtttaccttccatgtgtcttctcttgggaagccactaagtaatatgctccaccaaaacaaagaaataaagcaagaaaatagaagaaatgaggcccagaaatcagagaacccaacatgggaaggcaataaaagcaattcccaagatgactttaaaacagggattctcaaccttggctgcacattagaatggcccggggagcttttttaaaccctgaagcccaggtcacaatacagcaggctctctggaggtgcaacccaggtatctgtgatttttaaagctccctaggtgaatccagtgtgcagaggaggctgagaactactgtgttaaaggaaagtcccagaacaacagctgtgcgccaggcttacaaacacccaggacaggttaaagcaggaggaaagagggatccaggagggagagaaaaaaaaaaatccacaagttatctgacaggcataagttggaaaattgtttagaaatttgcgtcaagaggcattttgtagaacagtcacaaaagctgtcagaagacagtcaaatgttcaaaggaaactaagaaaacgctaaaataaaatgtttaaagagttgtacagaagatataaccagagtataccgactggcttggcagtgagaaaacgtgtatatagtcataatagggaaagctcaaattactgaataattataagaatgagaggaagaaatgagttaataaggtctaaaattgattagtcaagagataccaacacatattaacagatattcggagctaactaagaaaagaaacaggtggtgggttgcataatggccccccaaagacgtcccaatccctggaatctgtgaatgtttctttatgtgacaaaagggactttgcagaaattaaggatctggaagtggagagattagcctggatagtccaggtgggcccattgtaatcaaaagggtcattataagaggaaggcagaaaggtcagggagggtgcagaaggttgggtgagatggaagctaaactggagccatgcagccgtgtgccaagggtttgcggggacaggggacagatgccccccggaagcttcaaaaggaaccattcctgttgataccctcattttagcattttaaaacccatttttattgctgacctccagaagtgttaagagaataaatttttgttctattaggtcactacattcgtggtaatttgttacagcagcaaagggaagtgttcaaatgttgcggtggaagtgggattcaagcggcgcaaagggacacatgttaagtactttatttgacttcttaatgaatgagcatgtgacacgtagataaaaattacaataatcaacctgcactgagtgctcacagtagtgtgagagaggagagctggagaggcatgagctatagagcttggcccctcagacattaacgtgcacacacatcttccatggactgtattaaatacaagctctgattcaggaggtctgcagtggggcctgagattgatctgcatctaaatctttgctcctgatttcaaaagctttgcttccccttaccttgcttgcaaaagctttgcttcccctcacccctttgcagaagcaaagatttagactcgaggccagtcctccagaccccagaggactagaaaggggccattctaaagaaagagacagaatctagaattaaaggagagacggagggacagagagaggaaaggactttgtgcctaagctaagacattttgattttatccttgaagatatgggggaccactgaatgatttggggaagtgaaacaccaggataagattttttcacatcgttattcttcgttgaggaagtaggggcataaggccgggtgcggtggctcacacctgtaatcccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacttaggaggctgaggtggcaggatggcttgaacctgggaggtggaggttgcagtgagccaagatcatgctgctgcactccagcctgggtgacagagtgagaccctgtctaaaaataaataaataaataaaaaatgggggcagcaaaccagagactagaaaccatttcatatttgactagaaatatgcagcgatggtcgctgaggaaggtctgatgatgctggtacttctgcctacacacacaatacagagaactatattaatccacatgtaaaagtgaaccctgtaaatatctcttgtctgaagtcctaagccaaaaggaattttcttgtaaccactaaaggatttttcttgtaatcttttacattgacataattttctagtatttattaaatccccatctgccaatggcagatccacttttaaaggagaaaagtacaagaggaaaaatcttttcaggaaagttacattaggtagtaaaattaaagtattaaaaattatatataaattcttccagctcatcacatcccatatagatggcaatcacatagtgttcacattctataagttgaccatagctaaagtaaactgcaggtgtcctctttttacaaagaaatgttcttcacagaagtgcaatgtacatatttgattttcctacaccattagaaatgattctgcaaagcattctcagaagaattctatgcatatggatgagacagaatgagaagagtataatatgggtaaaaagtcaattaaatatattgaacactgaaaccgtattaatagtttggggtcaaaatcggagcagctattgcgtggagtttataaggaaccgtcctgggtccaatctccctccatattttctattaatagctctgaggatcctatgacaaatgcactaatcaatccacagaaaatgcagctctgggaaacattgctaatgctttggatgacaatattaaaattcaggacgatcttgttaaattgaagaaatgagccaaaatcaatagagcagcacacgcagttctgccaggtgttccacattgcaggatacagggagccctcgaacggaaaggaagaccagcctggtaggcgaaactccagctggtaaagctatccaactcctgttctccctctccctccctgacagccacaaggatatccagacaggtgtttagggctgtcatctacacatgatttaactccactgcctacagcttctcaactctttcccccagagcccagcagtgagggaagagagatgatgaatttcctttaatataagttgtagggcccacactgatgaatttagactttagaacatcacattagaagcagaaagaaaaaaattaggaaacaactaaagatttctaagtaggagtataatgacctcttcctaaggagtgtcataatatcttcctgacatttaaaaacatggtctctattgagaaaggggtaaggggagatgaagatgagggttctttaacaactcatttagctacccaaactctgagaaacctgagactttaagaaacttaaattcatcttttctttcagctacaacccttatccagagtcatccttaattacacttactttcttgtccccagttagcaagtcaataaacaagccctgccgctttcaccttctaagcagttttctgacctgcactctcttctccatcctctcccccgctgtcctagctgaagtcttcatcattctttacccagactgatacagaagccttggggggcctctctgcttctctattcctttagagccctccttcacaatgttgccaatgtgatccagaatgaaaacacaaatctaaccttgagttttccctgtttaaacatttccaataccctcagtgctcacagaatggggtttaggttttccaaggtggcatgcaaatttctgtggtggttttctaccaggagcaccatgagcacgcagtatgcggggcatttctacatgtctcattggtaagcactgtgtgggggcatttctagatgtctcagtgtctgggtggcgctactggcccttcatgcccagggcctagggatactaagcatcctgcagtaatcaagacaactcacacaatgaactgtcccacctgaatttccagaggtaacaccattgggaaagggtcctcaccgttcctgctcatttctatatccttctagctcacttttctgcactgcagctacataactcttcttccgcaacacaagccatgcttatttcttgcatttataccttaattcttgctctatgtgtctttattaattctgatacctggaaagactcatcactttactgattcatagtttaagcttctgctctggtgtcatttcccaagaagcatctaacgcacatggtctgacttagatgcttcttcctgataaggcagtagtgctttcttattgtgatatgctctgtgctcagcagtttgctttaaaaccattagtgttctcctttactaaggttcattgggcagaaactgtaggcacttagtaggccttatatagacctatgaatttaaagaatggaaggaaggatggatggatgcatggatggaaggaaggaaggaaggaaggtaggaaggatggaaggatggaagaatggatgggtggatgggtgggtgaatgaatggttgggtgagaggaaaaacttctctgaggctgttttagtccaggtgcccataaaataatacaagcattattttatagctcaggcaacagttgaggtcaaagtttcggatcaggtcatctgtctttagttccagcattctatgatgtacaagtcactctatatccctcatcttcagtcactaaatacctctataaaatgtgccaggcagcaccctgcaaagtaattcacttacccatgttgaggattgtgggccacaaacagcactttgacaggcacttctgtctggcgattctgtgttcagtttgctcaagaactcagcggttttgctaccagaaacacaaacaggtgttagtgccttcacaaaaatatgaacataattctttatttttcctttggatactaacctagacttatttgggtgatgattaaaattatcttcagcagaacagaaagttacgttgagaacaaggtgtagcagaaatcaaaacaaaatgctattgcaagattgcattcttcaagaacaatattacaaaattataaaactagctttatgaaatgtgagcttatgacctcattttttccactttatattactgacataaatacaagtcctctcccagagcacattccacagcatgcagccctaatttcctatctgaacatttaatgcttaacactcagacttcagggtggagctgtggaacattcacgccctacaacatcctgcttcacaccagttttacattaagccctttaccctctcatctgcctcatggctttgaccactgttaggacacagagaccctctaatccagtagctcttttccatttatggatcatggagcccttttggactctgaaagcaaaagtgaaccctctgttaacagacacacacacacacacacacacacacacacacacacacagtcctttgcattttgtttcagagagaggataaaccctccatagggtttatctatagaggttaaaaagtgctgctgattctagactgcatttctaatatctctttttagctctgaaaaattgacctagaaatgtcctcagtttaaataagaagttctctgtttttaccttaaaaatccaaaccaccaccccaatttcccctctcacttatgccaagcatagaacactggaattgtttcctagtccttacctcagtgcctggcccattctgcctacccttgattaatttctacgcctttgtccttttctcatgtaatttgtgtgatttttatctcttcattgcacattcacagccacatacctcattgagcactgacttactttgcaccagacttgcgcagcctgttcccatctccctccctcctcctgctagccctctgcttccccctaatattttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacaggtaggggcctgcagagtatgcggattactgccaagtgatcaactatacaaaggaagtcccatgttacgacactaactcatatttttctactattagcattagtccctggtatataaaatttccatatattggctgaactgaagtgggatccctgtaggtaactctggttatatttaacaaaaataagatgtagaacctgtttgaggggcaaacgaaggaaaacatcctcgtgggaagtccaactggactaagaaccctggactctagcactgttttcaccttgcccttgggggttcttggtattatcactaccgtgactctactgcctgttggagaggggtggtcctcttccactttgtcactctgatccaagcatgaaagatttcttcctctattctccatagaacaaaataaaatttacttatgtccaacttaggatctttaagggtccttcctgctcattcttaggttgatttctatggcatatcctgaaaggtcccttcaggaaaatctcgcctcaacagaatacagttgtagcagactgctaaatggtcatgaaaatttacattctcctcttctggccacacaacttggctacatttcctagcctcccttgcagctaaggttggctatatgattgagtcttgaccaatggaatgtgagaagtgttgaatgccacatccagtactaacttattagaaaattcccatgcatgtgcctccatacattgttctcctggctggaacagagacagccctcaaggaaatgctggaagttgtgcattgaaggtggtggagtctctatcagttttggttcctaaatacctgagtggaggaggctgcctttcaaattatgacacaatggtattttaaaaagcagtctatgctttttgtgaattcacttatatgtagtaaaattagaaacacttgccaagtgagaagagcagctcctggcatccaggaactgatctgatgctcacgtctaaatctcagtgttattataaactgatttgatctgacactgaagttaagccttgttccactgttggatgtaaatagtcacacagaatatctacttcacacaaggtcatcatgcaatctacaaagtaccaaacatcatctcctctaagtgaatgaccactacttcttcactaattacagcttcgtagtcactctaggtccttcctataggtaagatttattgagatacccaatcataaaactgtccccacattctgatggcactcaatccagagcaactccctgcctccgtagaccctccccaaaattacccaaccaaagcacaaatcctgtagtagggtctttctaacactttctccctgagataactcaccattccctatggtatgcattttcctttgctgcaatgagtaataaacccaacttgttcaactacaggtatattcctggtagtttttggttaacgcacattgacaaatattacataccaggacagtggttactgctagagaaagacagagaaggaagggatgagggtggagggacagctagctgtctctgtaatatttatcttttttaattaaccaaatataagtaatatcttaacaatatgagcttagtggttgatgcatattttctgtgtgtttgaaatgtttcttaaataaaaaggggataaaaaaccccacacagactatggtggtgtttactagggaaagacttggcagataccattccagatttcatagaacaatagtttccagaatgccagtgggaagaccagtgtggggctggctatatgagaatcatctgtggtgcttcctagaaattactggactcaggcctctgactctaattgagcatgtctggagtgggatctgggaatctgcgtttcttaaaagcacccctggtgatgttaagaactactacagtagtacagatggatattcaatatgcataattatcttaagtctacatgactctgacttatgaataattcatgttatacaacacatttggaaataaaacctcagcgtgtcttaggaactgtctgtataagtacaatctaataatgcattctacatgtattttgcaatagcttcacaaacctgaactttgccaccatgaggtttaggtaagtaatcattcgtacatgcatgcatgcattcatgcaggcaacaaatatttcctgagtctctgccatgtgtttagcaatatgggttataggacaatctaaagaagtattattttgcttaagtcagtttcacataactgggtatgagcaaatgacattcacacacctataagcactcacagagcctatgtaagtaagagagtgagagataatctattgggatacacaaaacccatttaagaaatcacaagaacaagatttacaaaacaaaacatgaaagtgagtagtaatgctgggagaactttgtgcttaatcaaagtaatcaaactattgcatacactttacagaattctttcccttcatttatctggtctttaatgatttaatttttaattgcaaaagcaatacataaatacgagtcagaaaatagaatagaaattagataaaaatataaagaaaaaaagtgaaggtcctacttaatacctctctcaacctgactcctttccccaaaggacaacatcatgaattgtcaggtatgtatcctgattttctattaattgataaatatctatttaaaattacatacaaatgaatagtggtttactttgggggaggataattaggataaggcagagaaggccagctgttctctaaaatgtgtttctctgcttcctgcatatatagctagactacgtttcccagctcccacgcaattagatgtgacataggagcatacatctgcattctggccaatgaaatgtgagtaaatgtatgggccaggctgaagtgatccacatcaataacctctcacagcattcttaatactctttcctccttctatctgatgatggtatcttaagtgagcctgcaaggcatttgcaaaggagagtagagctaccttttgcctacagctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcttcccaaagtgctgggattacaggcgtgagccaccgcgcccggccttgcctgcagcttttaatgccagggggcgaaagctaacctgactcaaacatcagccctggatcattccacaagaaagatataaacttcttgttctttaagtcactgaaattttggtgtttatgttttttaactacagcttttcctaccctaaactaacagacttttttctttaagtgggatactatattttgttctgaaaatagatttttgtcatctaaccacatctttgagatttttccatatttataaatatatatcttattccttttggcagctgaatagcattttatgatatggatataatacatttaacattcttatggatggatatttatagttttttccagtgagcatcctggtatatacatcttgtgcaaatacataaatattttttctaagatatacacctagaagtagaattttattctaatataggttcccataaatagatatgcaattttttgtttttgtttcttgagacagggtctcacattgttgcccaggctggacagcagccttgacctcctgggttcaagtgatcctcctacatcaacctcccaagtagttgggactacaggagcacaccacaatgctcagctaatatttttttagaggtggggtcttgctgtgttgcccgggctgatctcaaacttctggcctcaagtgatcctcccacctcagcctcccaaagcattgggattacaggcacgagccactgtgctcagtctattcacgattaaaccatgcttaatagtgccaagctgatctacacaaatttatattttcaccaaaagttaactttatgaaagtggcaattcagaaccatggctaacctcctgtaagtactaattctatcctgtcttacacattcctatttatctcggtcaccaccgagtgttccagtctcacctatcactcaatatgactcagtctctcaatcccacactgccccatatatctaccacttaagcccccacacctccctctagccttccaaacctttccaagggggcaaaagtctctcgatctttatccaagagttaacaactcaggattcttaacctcatatcagaaagtctccctcaaatacaaaatcaccattaggcaaacatccaggtaaaaaaaaaaaaaaatgttggcaagattaatttacataggctaaaatcactgggcaaaagtttgcagataacaggatattagtatagtcttaaaatatctcccccaaaacattcatcaattataaagagaaaaacaataacttaacagtggagaccaccttaccaaatgatccaagtaaatatcaccagtgataaggatactgatcatcatgtaccctctgatgcgatgcactgagaaggacatggcatcacttctgtaattttcttgttggaaattataacttcaagctattcatgagaaaacatcaaacaaacccaaactgggggaagtctacaaagtaactatccattacccactgaatgtgttaaggtcatgaaagagaagggaaaaaatgaggtactgtcacatattggaggaaattaaggaatcataatgactggatgttttatgtgatcctgaattggatcctgaaatagaaaaggagcactggagggaaactgatggaatatgaataaggtctgtagtttatattaatagtattgtaccaatgttaattttctgattttgatcattgtactatggttgtataagatattaatgttagctagatgaagattttattggaaactatttttctactatttttgtatcttctctctaagttggaaattatttcaacataaaaagtaaaaaaaaaaaaaaaaaaaagagtctgcctcattttcccacattgtctgaaacctgaccacctcttgagaacagtacttcccacaaccccccgaaatggaactattttacttccatatacatattccttggtgcctgaaaatgaagcagacatcctgtttgctcccaatctacttccagaccattacttcccccatcatttgcaaaacatgtttgcttctgtagtacccacaacacagaatacaccatcctctttgccattgtcatccttcaaccttctggtcaaccatctctcatttgtttaagatttcagcctttggtgcacccaggaggtgtgggtatcatgtaattggcagttggtcaaagctggtgccagacccagcctcctgaaggaaccatgtcctgcagctttgggtgccactcgtcatgtcaggcacacactgctgcccaagcggagctgctctttgaattctctgtgaatgctgggaggaggaacaccagagctgctggctgaaaattgtccaaacaagaggaatacccccctgcatggacttcctggttctcttcctgctctactggctttggtgctagttggttatgttatgacctgtttttgctagaaaactcatgatttgaaatgcctggtcagggcaggggcacagatattttcctgtataattccagaatgtcttcagaaagccatgtaaagattgcttcactacctcttccatacatgaaaccataccttcattatccttcacctggtcttgcaaggaatggtaaatactgaatatacctgggaaatactgggctaccgtcaaaagctagttctcctgtattaccttcttctgccctgtctgcttctgattgtaaacccgtttatttccaccctaacttgtgtaactgattctggcattataagaaaagcaaatgaattatttcttcaagtttatgaattcagtgatgtttctaaagaggtgaggtgctctacttatgagttacgaacaccagctcgatcaaagcactgactgcagtgtgtgcaccgttttgaccatcgttaggtttgggtgaacaactgcatctgggcttggaacgccagttattaatactttctcatctacctcttgatgttgacggctttggctgctgccatggccattgtgagcactgcgtttctggtcgatttggtggtattgttggatttgtactagacttacactgatgaccttggacacttccagtttatagacttgatttttcttatttagtacctgttcctgacctttctaacaattgtcttcatgctggggttgtggttggggggacgttgtaatggtcctgagctttctcctgggtagctacctgtgctttgctctgtacctggttgccatcaaccagactactaatgagtggtacagaggtgactgggccccatgccagcattgccccctcatggcctggcccccatcaggaaagctccaaatctaccagaacattcactcccatgggctctggagcaaactttgagagatctttctacctgccattccaaataatgagagaaagaagaaacaagaatggaagaagtgtcactgccttttaaatatagtatgcatttattatttaagaaaaaaccttcagccttcctccctatcttgactactgtcaacatggatatcctatgtgctgcccccccacaggctgtgtttcttgatttcttggtctccagtagctcttcttcactccacctcagccacactgccagggccataccctggacattgttgtcatgaataaatgtcctctctccaaattatctgacaaattccattcctgaatacagctttctgtcattccatgttcttctttcaagtactatcaatataacaacattccagtctctctgggatttctaaaccactgattccccacctctttctaaccatcagctcccatctattttaattcttgcgcagcttagagcccatagtccattttttaaatctttcccttacaaatgcctttcttcctcttctccctgcttccatcatatatgtctgtaaaaatctcaaacctagatcaagtcaaccatctgctttctctgagtctgcaccagaacaagtaaatcaaacttgggaaaaataatacatctggtgtttggggatgggaggtatgaaggaggagggagtggtaaagtagactggcttcaaatgaagtccattaactctagcttcatcctaccgaattcttctactccatttcactcataaattcttttttttattttttatttttttgaggcagagttttgctcttgttgcccaggctggagtgtaacggcgtgatctcggctcactgcaaactccatctcccaggttcaagtgattctcttgccttagcctcctgagtagctgggattacaggcacctgccatcatatctggctaattttttgtatttttagtagagacagggtttcaccatgttgcccaggttggtctcagactcctgacctcagtgatccacctgcctcagcctcccaaagtgctgggattagaggtgtgagccaccatgcccggcccactcatgaattcttctcctgtaccttttgtttgttctcagttctcagctgacaatctcctcatacttcattgagaatagagaaataagtctttcatcttctcaacacgaaatcttttaagtcttcctatatctgtacctatcttcctttaacaaaaatgtaaagactgcttcctcaattataaaaggagaagtactctccttttaatcattgactaatcattaagcattggttatgtatactcaggaacttattcatatattctttctcaagtttatttcttctgtcatccccttgtgtctagtcttcccctcctctcctggatcatttctatcagcatacaaacatgatcaatttaagaaaacttttgattccgcagcctcatccagttactgcctcatttcattgttctcattttcaaattattcaagagttactgataaatgccaaatctattcccatatctccatttactcgtaagtccaattcaatcaagctccagccccatcatcatacccaaatcatttatgtcaagatcacagccactgtcactggtccttctctcatttgaactttcaacactagtaaggaattgactaatttctcctttcggaaatatgtctgtcctgttttccatgataccacactcttaatttgcccgacttctcggatgtcctttcgtatctacccgaactctacatgatagagctcctctgtatttggtcctgggccctcttctcaaacctgcaatttcatcttaagtgactttgtccacttttatggctttatatttacatgctaatataattcctaaatttatatttcccacatatctgctcagtgagaccaaattcgtgtgtacaactgcccatttgatatatccaaaccatctcaaacttaaactcttgatatttttctaaatatgtaaacttaaacttaacttaaactcttgatatttttcttcccaaaccttggttttcacctagtagcccccatctcagtacatggcatcactacacctccagtacttcaagtcagaaacttgggagtcatccttgattcttcctccttcttcatccccaatatcaatatgtcctattgaacttacatacaatatgtagttatagtcatacgtcagagatattgtgagtttggttccagaccactgcaaaaaaagcaaatgaaatattgcaataaagtgagtcacataaatttttttgttttccattcatataaaagttgggtttacactagattgtagtctcttaggtgtgcaatagcattatgtcttgaaaaatgtacactttaatttaaaaatacacgttgttgctaaaaaaaatgctaacatctgagcctttggtgagttgtaatctttttgctgctggaggctcttgttgataacctgctgactaatcagggtggtagttgctaaaggccagagttgctgtggcaatttcttaaaataagacagtgaagtttgccacatcaattgactctttctttcatgaaagatttgtgtgtagcatgcaatgccgtttgacagccttttacccatagtagaacttcattcagaatggaagtcaatctcttaaaccctgccaccactttatcagctaggtttatacaatattctaaatttcaagtcatttaatcaatgttcacagcaacttcagcaggagtagttcccatcttaagaaatccctttctttgctcatccataaaaagcaactcctcatccgttgaagtttgatcataagattgcaacaattcagtcacatcttcaggctccacttctaattctagttctcttgctatttccacatctgcaagacttcctccactgaagtcttgagtccatcaatgtcatccatgagggctgggatcatcctcttccatattcctgttaatgttgatattttgacctcctcccatgaatcacaagtgttcttgatggcatctagaatggtaaatcccttctagaaggtttttaatttagtttgcccagatcaatcagaagaatcaccatctatagcctttaaaaatctatttcttaaataataagatgtgaacatcagatttattccttgatccataggctgcagaatggagactgcgttagcaagcatgaaaacattaatttccttgtatatcttccaggcatctcaaagttagcatgtttgaccttgaacttttgatatttttcttcccaaaccttggttcttggttttgatatttggtttagaaatactgccaaatatcctaataggtattagaaccaaggtttgggaagaaaaatatcaaaagtttaagttgaaatatgctaactttgagatgcctgggaaatatacaaggagattagtgttgttttcatgggtgattaggtgcattgtcaatgagcagcaatattttgaaaggaatcttttcttctaagcaggtcttattagtgggcttaaaatattcagtaaaccatgatgtaaacagaggtgctgtcatctaggctttgttgttccattcatagagcatacacacaatttagcatatttttttaagggccctaggattttcagaatggcaaatgaacattggcttcaacttaaagtcaccatctgcattagcccctaacaaaagttagcctgtccttagaagtaggtattgacttctcctgtctagctatgaaagtcctagatggcattttcttccaatagaaggccgtttcatctacattaaaaatctgttgttaggctgggtgcagcggctcacccctgtaatctcagcactttgggaggctgaggtgggcggatcacctgaggtcaggagttcaagacaagcctggccaacatggtgaaacaccatctctactaaaaatacaagaaattggccaggcatggtggtgggtgcctgtaatcccagctactcaggaggctgaggcaggagaatcactcgaacctgggaggaggaggttgcagtgagctgagattgcgccactgcactccagcctgggagacagagcaagactctgtctcaaaaaaaaaaaaaaaaaatctgttgtttagtatacacaccttcatcaatgatcttaactagatcttctggatatcttgcagtttctacatcagcactttctacttcacattgcatgtttatattatggagctggcttcttcccttaaacctcatgaaccaacctctgctagtttctaacttttcttctacagcttcctcatctctctcagctttcatagaattaaacagtgttagggccttgctctagcttaggctttggcttaagggaatgttttggctggtctgatcttctatccagaccacttgaactttcttcatattagcaatacagctattttgccttcgtatcattcacatgttcactggagtagcatttttaatttcctttgagaacttttcttttgcttcacaacttggctaactaatgcaagaggtctagcttttgtcctatcttggttttcaacatgcctccgcacagagcttagtcatttttagcttttgatttaaaatgagagacatgtgatatttccttttacttgaatgcttatgggccattgtagggttattaattggcctaatttcagtattgttgtgtctcaggtaataggaaaatccaaagaggagagagagatagacaggggaatagccagtcaggggaacagttagaacacacacaacatttattgattaaattcactgtcatttgtgggcagggtttgtgggtccccaaaacaattacaatagtaacaacaaagatcactgatcatggatcaccaaatcagatgtaattataacgaaaagtctgaaatattgtacagattaccaaaatgtgacactatgacacaaagtgggaaaatggcaccaataggcttgctcaacacaggattgccacaaactgataatttataaaattttaaaaaatgaaatatctgtgaggtgcaataaagcaaagtgcaataaaacaaggcacgcctgtacttttctctgcactgacatcacttaagctgagccaccaccaactcttatctggactactgcagtaacatctttagtagtttctccatttattctcttgccttctcaaatctattcacaacacagcaactagagtagtcatttctttttgaaaaataaaaattttctacaggttatccctgtggcttgaaaaacatgcagactctgtgccatggcctgtgtggtccacttgacctgcctagctcctgcctgtcttgtcaacttcgtcatctctttttttcacttcagcccgaacataccagcttcctttcaggttgctgagtaccctatatgccattgcctcagcctagaactttctttctggttctcagtatggctggttccttctcatccttttatcttcagttcaaatgtcattttcttggaaagtcgggtcctacctatcatgctaaggaggtgttgccttcctagtaccattatgttctcttaccctacctctaacactatgttccttcataggaattgttcgaatcctacacagttatcctacacagttctttgtcagcttgtctattttccacatttgctcatggagccatatttgctttattcataatagatgcctagaacctagtatagtgcttgacacacatttatcggtgcttatcagtctagaggatttttctgtttggggtttttaagagacagggtctcccctgtgtcacccagcctggagtgcagtggtgtgatcataactcactgcagcctctaactcctggctcaagtgatccacctgcctcagcctcccaagtagccaggactacaggcacgtgctaccacacctgaatcatgctcattgttgaataaatgaaagctcctttcctaatgtgaagtattatcaatccattgatatttttgccactgaaataataaaatctatatttgtgtttatctaatcattagtgaaactgaatattttgattcctatttcctcttttaactgcttgttcaagtaatttgccaatttttgagttgttattttcttattatcctataaacattctttgtgaaattaagcctttatccattatgtttgaggcaaatattttttcctagattattatttacttaaaacattcttcattatatcttctatcatagattttaaaatttttacgtacttaaagctatggtctctctttatggcttctgagatttgtatattgcttaaaaaggagtttctaccctcaaagtataaaatcatccttcactacatttttattgtgttgattcaatacaaattgtcaaattgtctattcttttgacattggtttgaaagaaatactttcattcatagttgaagtcctaaatactgaatttttatataaacatgggtctactttagattctctatagcattcaataattcaattcatagattgattacaatgccaataacagtttgttattccaaccagctttaaagtttttagtcttttatctcaaagtaatttcagttttggttttaatttttccccaatagtcatttttaaagatagtttaaattttttaattaaaaaattagctgggcctagtggtgcacacgtgtagtccccctacgtgggaggctgaggtgggatgattgctcaagcccaggaggtcaaggctacagcaaaccatggtcatgccactgtactctagcctgggtgacagagcaagacactggaaaaaaaaaaaaacagaaaaaaaattttttaagtaaacagactataatttcatattgcttaatttctaattttactccatttttctcaaggactgtggctttctaggatttggggtgttttttttttggaggttaccaagagtctttgaggccttgaacatggccaattttgtagtagattttagtcagtcttcttaaagtcagtatttataaagaatatgtgttttcatatattgggtacattttatgtctatacaattatgcttagcattgttattcaaatcctcctttctttacagagttttttggttcacttggtctgttaatttctatggagaattagttaaataaaaggaaaatttggcaaatccatagtctatattagagacaaatagtttttgtcatatgtatttcaaacctattttgataaagatttgtgacttgcattttcctttggattatatattttatctgcataaatatcttttattgtgttgaatgtttttcaccttgaattcaatttgtctcatactaatattgctgcttttgttaacatttacgtgtataactttgttttcaactcgatttatagatattctttgtaatcaaatatagctagatttgtatttttctaggcaatccaagagcttttattctaataagataatttagcctgtatacattttttgtgaatgctgacttattggacttaatattttgcttgttactttttattgaaaaattcccccttcttttctgccttttattgtaaaggcagaaattgacgatcaaatttttatttgttgtattatacttatatgtttttgtgttatttatcctaatttgtacatataattagcatataattaaacatataataagcacatttatttttctatcaatctctggaattgatatcaatatccaacattcactcatacaacaaaggaaaaaaacttattgtagttcatatccctgtctcttccttgtgcctcttctagtgctaaaatcctccatgattttaattagatcctgttgattctttttttttttttttttttttttttttttttttttttttttgagacggagtcttgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccacctcggcctcccaaagtgctgggattacaggcgtgagccaccgcgcccagccctgattcttatttaaacagaaaaacaagcacatatttgaccaaaaatgtcactgtcttctttgttcacaattgttctggtatctatgccttcctctttcttggatttactacttgtttgactagcattcattttcatgtaatttttaaaatacggctcttagagctcacatagaagtgatgaagttggctatgcagatggcttgtctccagaatggggaccacatattcccccaggtatagcatgtttaccagaagcactttctgggccccagggccttcttagtgaatcttatgcatcaagaagagttctcaggctctattgttgggggtaaaggctggagttggctgctcactttccttcacttcttcctctgctgtccttgttggagttacactgtattcagcgtctctttccaaacactatcctggatctcttatgtggattgtatcagttaatcttcttctgagttagcagttattgttaccccctaccccaggctatatgtgaggaaacgaggccccaagaggttaaataatgtcctattaatgaggaaaaatgttataatttaaactcaggcagtctaacccccagatcccctgccctcccaaaaggagaacatggatggtactaggttccagtgataagaaaaccaagtgaaactattttgtaaaaaaggaactagtcaacttttatttttttaccaattattaattgcatacagagaaagacaaaaactggcctggccaacctacagaatgggagaaaaatgttgcaatctatccacctgacaaagggctaataaccagaatctacaaagaatttaaacaaatttaccagaaaaaaacaacctcatcaaaaagtgggcaaagcatatgaacagacacttctcaaaagaagacatttatgcagccaacaaacatatgaaaaaaagctcactatcactggtcattagagaaatgcaaatcaaaatcacaatgagataccatctcatgccagttagaatggcgatcattaaaaagtcaggaaaaaacagttgctggagaggatgtggagaaataggaacacttttacactgttggtgggagtgtaaattggttcaaccattgtggaagacagtgtggcaattcctcaaggatctagaaacagcaatatcatttgacccagcagtcccattatcgggtatatacccaaaggattataaatcattctactataaaggcacatgcacacgtatatttattgcagcattgttcacaatagcaaagacttggaaccaacccaaatgcccatcaatgttgggctggataaagaaaatgtggcacatatacaccatggaatactatgcagacataaaaaaggatgagttcatgtcctttgcagagacatggatgaagctggaaaccatcgttctcagaaaactaacacaggaacagaaaaccaaacactgcatgttctcattcataagtgggagttgaacaacgagaacacatggacacagggaggggaacatcacacaccagggcctgtaatggggtggggggctaggggagggatagcattaggagaaatacctaatgtagatgatgaattgatgggtgcagcaaaccaccgtggcacgtgtatacctatgtaacaaagctgcgcgttcttcacatgtatcccagaaattaaagtatgataaaaaataaaaataaaaaactggcctggcactcacagctaggccttggtgttctcctgttgaaagtaaccaatgttacataatgtcaatatcagaagaggtcactgtgactataatagctcataacaaaaacaagatcactctataacatgtctgaacacagaaaaatacatggaccttgtagaaactataatagtgaccaaagatcccaaaattatggctaatatgagtgacttctgcttctttatcaattacagcatgagtctcactctggtcttccttccttctagatagaattgattaagacacctcatcatagacctacccctgcttcctgataagatccaattcagagcaaagctctgcttccttaaatcttcccctaaatcacctacgtattagtctgttctcacactgctaataaagacatgcccaagactgggtaacttacaaagaaaaagaggtttaattgactcacagttccacatggctggggaggcctcacaatcgtggcgaaaagtgaaggaggagcaaagacacatcttacacggcggcaggcaagaaacagtgggtgcaggggaaccgccctttataaaatcaccagatctcatgagatgtattcagtatcacaagaacagcaatgggaaagacccacccccatgattcaattacctccggccaggtccctcccacaacacatgggaattatgggagctacaattcaagatgagatttggatggggacacagccaaaccacatcaacctgacacagacccaaatgctataagtcctttctgacatctaagatggcccatggttccccacggtgtggctaaggagtctggaattcattttataggcagtaggaataggagataatcaaatctgtttgaccagtagagtgacatgactaaagctatgttttagaaaactaaacttgacaaaacatgtaagacaatgaagagactggttgcaaagatagtaacaaactcactgcagtagtccagggggtgacaagaaatcacaaaagacacaggccatgattcaagtggcatgtgataatactgacatcagggcagtggcagtgggaatgaaaatgaggtagcatacaccaggatatctgcagggagaattgatagtgggtagagattgtgatatggttctaaccatcaacataattttacattcaataggtaggaattcctctgaccagatttttcataagctgttcagtcttattctgaacaaaatagatatgagatttttgtatctataagttcactttattagcataagatagaaagttatgaataggatgactttctattcaccttacctggattataaaattcaaggctggatttaagcctaccatatgggtaagggatcaactgagcccttaagtgtctttcagaagctcccatgaagggcattagaagttttgtgagcatattggaaggcaaacttggtgcctatgtgtgcatattcagctgacttgcctggattctcagctctaggagactaaaatagatgaagatgtgccccataggaactaatcacactattattcaaatgcaagtaaagaagatgcatggtttcaatggcaaaaatgaagaaaactttccaatattacaatcggcaggctgagctcaaggtggtgcaaggcaatttagaaataggaagaccctattttggaatgcgcttggttccaagagcttttccaactgaggtttttagaactgagccccttgtcccctagaaacaatgttggaaattgtacgtaggaatagagtgcagccaggagaggtcacaaaagcccacctaccctacagtaagtttaattacggtactaatccatgttgggtctgggaagaggaggtcattcatatatgctgatcccagagaaagcagacacatttcctctctttacttttgcctattctagcaaaatccagatattggtaggaagaaatagaagtcaactgcccaagtctttctctctgagctgtctgtcccaccctctccaatagtcctctccacaggtagcctgtgtttctacagtgctcaccacccctatgtattttgaaggtcaggaatatctgagcaccgtctcctgtcagaacagcagcggtattagaatctcataggagaacaaaccctattgtgaactgcacatgtgaaggatctgggttacatgctccttatgagaatccaactaatgcctgatgatctgaggtggaacagtttcatcccaaaaccatcccccttgccccattcatggaaaaattgccttccacaaagccagttccctgtgccaaaaaggttggggaccactgctttatatacactataaacacagataagtaaaacactactcacagatgtaagggacaatagttactcttgcctcactacaggcacacgggcatagactctttccacttccccctcctccctcctcccctgaaacacaatgttgtattactcaagaggtggtttggccagtccccactaaaaacaacatttcatatgaatttcaacaaaaagatattcacaaaatgtgttattttactacctgtacttttaacacatatcaggcacttcagaacatctagaagaaagcccagacatttcaaaaaaaaagtacttagtattgccaaccatgtatacagtagtgaggaataaaatacacacacaaagcgatggttaaaatatgaaaatgtctcctaaatatgatcagtctagcatggagccttcttctcctccttctcaggtcttccaccccaagtcctcttatccactgaacaattgtggacatgtcatccctgatgtcacttccagaggtggtctcacaaatccatttcaaaaagtcatcccagaagacattttatatgattttttttaagaggtgagcatttgcaagatgtgtgattttatgactcttttatcataatttggcaaaacctatctacatctagaagggctagatgtagcaagtgctcttttaaaaccttggggaggtcagttgagagcagtttttcctatgacgtacacagatcttctacacagggcctgtacatttttccaaagaccagtgggcctttctgttgcccaaatgtggcttatctcctactgtttctcttctgatatgaaggtatgatagatgggagatcaaccccgcctggtggcttctagcagtttcatccgtcagggctctgctcaccttctggaccgttaaggccttggtccattgtcatcaataacgaggcaggcctcacccaactgggacagagtggtcaccccaggccccggtcctgctgggtttcaggccaacagaggtggcggagttgggtccgtctgcagacccaccttccaggcctcaccccacagcgctctccacggtgttcccgcagctgccaggcttcccaccctgcacaccggcgccacccaaagcggctgcatcctgaaggcttcatctaggccaggcagggttaggccgggaggcccagcagccagctgggtctgggctcagagaggcagctgcctgatggtcaaagaggtggagtggagagaggggccctcctctgcatcaaggcctgggccctgccagtgcacagccatggcaagggctccaggtgcctgcagagcagaggcttgcttgtccttggaccccagctttcctgggagggccataggggaagtggccatgcttcacttctcaccaagctctctgcaggaactccagagtggcttgttgttttttttttttttttgctgtttgtttgttttttgtgtttttttttttgtttttgtttttttcggtgagacaaggtctcgttctgttgctcaggctagagtgcagtggcggcatgaccatagctcactgtaacctcaaattcctgggcttaagagatcctcccacctcagcttcccaaggagctgggactacaggcatgcaccaccactcccagcaaatttttgtattttttgtagagatgaggtctccctatgttgcccaagctggtcttgaactgctgacctcaggtaatccacctaccttggcctcccaaagtgctgggattacaggtgtgagccacagcacccagtctcatagcagcttcttattactttatttgattaaaagaacaaagcactttgtattttaaaaccatatgaatatataatctgttacatttaatgtgtaaacaggagataaaatcccaagccccccaacagacttaatggattcccttgtagccaagtggattccagaaagaaaaactaaattccaaattctaaatgccccctcccttttggagtttaggcacaactaaccagcacattaaaatagacgtcatagactgccctaacactaacagactctttgtggcaataagataacaaattccaacctgactccagtacagcatcacacgacagatagcagaccctgaaggaaataaaaattttttaccccaaaatatatttctttggcatattttgaaatggccctgtaaagctgtcttttgtggggaaaatttgcatatgtagagacactcttaccccttccaggtcttccccagatcaaggagagataagtgagaatctgttatctttaagggttgaaaagagaggctttggcccaggcacgtggctcacgcctgtaatcccagcactttgggaggccgaggcaggtggatcacatgaggtcaggagttcaagaccagcctggccaatatggtgaaaccccacctctactaaaagtacaaaacattagctgggcatggtgttgcatgcctatagccccagctactggggaggctgaggcgggagaaatcgcctgaacccaggaggcagcagttgcagtgagctgagattgagccactgcactccagcctgggcaacagaacaagactccatgtcaaaaaaaaaaaaaaaaagaaaagaaaagagagacttttcttttttggtcatcaagtggctgttagacatgaattttaaattgttaatgtttaaaatgtagccaattcttatatctcgagaaaattcttaaaagaacactttttcctaatacccgcacacaaaatgaatctgtcctgcttcactcacattcctaccctagctgaaattcaaacctctcttaacactcatccaaaaaaacacaattggaaagatgactacaccccgcccccaccaccaacaaattaccaattaaaattttaaatgctgagatttattttacccaatgttttaaacaacctaaatcataaaatcctatcattgttttttaaaaaaggcttatcaactgttacttcacgtcttccatctaatagaaaagtccacccaaaggtatcacacatgaatttttataagtagtaaataattacagagactaaaaataaccttgaaagttagaccaaggctaactgccgatttctaccctctgttttcaggctcaagaatcctaaaacgaattctaaattatgaaattggagtctgtccctagccagagtagcagacttaatgcaccattaatctgttctgctctcagccgctcattgaaacagtcacagtcattcaatttttagggaaaagacagtactgcaaaagtacattccagaggtcttttcataaaaaccatcctgtgtgctccatctgcatgtgcaatctgcttgtgtattttcagccagcttgcacgggcagattaatgcgtacaattagaaagcaacctcacaggcattcaataaactgccttcattattacactcaggagagtccctttggatgtcaataaaagcctagttttctgcctgttagctaaataattgacaacactaaaaataatcagaagcaaatgaacgaagtcaagaacaaggtgttaagaaagagcacattaagattctcatggtggtgccccaggttgctatcatgagctttttctccagcaacttggatttatagtccgctcaagtccatggttgtcctctctacagaaaaaaaataccattcctggtttgctgtatgaatcacacattgcagcatggtgaaactagcaaagtattgactggtttgaaagaatttcttatgtacgtttctattttatgttccttcatttaacagtttcaggagaatctaatttgggaggtgggggtaggcagtctggttggtctggcaaaacctttgtgctgttaaaaatccaaagaggtggctgggtgcagtggctcacacttgtaatcccagagctttgggaggtcaaggcgggtggatcactggaggtcaggagtttgagactaccctggccaacatggtgaaaccctatctctactaaaaatataaaaattcattgggtgtggtggcattcacctgtaatcccagctacttgggaggctgaggctggagaatcgcttgaacccaggaggcggaggttacagtgagccaagaccaagccattgcactccagcctgagcaacagagcaagactccatttccaaaaaaaagaaaaaaaatccaaagcactttcctagacattttttccaccatacactgattctaaggaggtatgacaaaaacttgtcatatagacgatccatcttttataagtctcttttatatttctaactacatactcactgcttatttcatgagttattggtcttttaatttcaaaagtaattcaaaacataatactctttcaaagaagaacctcacacatatacctcttcttgtgtttctcaataggctttaaaaatcaatttgagatacttctcaattttagccaaactctgtttttcctggttaactgggacttttacaataagcagaagaaagagcaagagtgaaatgtgtgtgtaattgaattcagctccactgatagcaggccaggtggctgagggcaaacttcttttttctttatagaaaaagggtgattgatcttctgtatttagtaaaacacaaactcaagaagctggaactataaaagaaaggaggttggacgcacagcttctaatgtcttttaaaacttcaagaatctcttaccctttactttgccatatttagaactctccagagaatgaacccattcaactatccagtcctgtgcccaaggcccctcactgttaagtaggtcttccctcttccaatgtaaaactagtatgccacaagacaatgacatttgttctcatttgtgactctaggctactaaagttgagaggtgaagccagctggacttctgggccaggtggggacttggagaacttttctgtcttacaagaggattgtaaaatgcaccaatcagcactccgtagctaggattgtaaaacgcaccaatcagtgctctgtggctagcaagaggtttgtaaaatgcaccaatcagtgctctgtaaaaatgcaccaatcagcgctctgtgactagctagaggtttgtaaaatggaccaatcagcactctgtaaaatggaccaatcagcactctataaaatggaccgatcaacgggatgtgggcgcagacaaataaggcaataaaagctggccaccccagccagcagcggcaacctgtttgggtccccttccatgctgtgaaagctttgttctttcgctctccacaataaatcttgctgctgctcactctttgggtctgtgccacctttaagagctgtaacactcaccgcaaaggtccatggcttcattcttgaagtgagcgagtccaagagcccaccagaaggaaccaactccagacacaaagccaccagcccagcccctaatctctctcaactcttccggctgagcctcaaaataaattctcattcattctctacccatgaaaggagaggcaatgatacattcacagtcttcatctggtgcctccctcccaccatatctctctgcaagacagacagtttctcctggtacttagctccttagcttcccaccagctcctcactcaaatgccttctttagaagaagagttgggacagacaggctaaggattctgtgatgaaaatgagagtgatgctccttttagctaaggaggatgacatcacttaccaacactttcatcctaccccataccatctcccatctattttctggcctgggtagcagaaacacagtacctaacttgctaaggagcaaagcagagggttgagaaacgtctcttccattcctgcctctgaatcttaaagcaagaaggagctgcttatgatagaggcaggataattttagtggcatgagaaatcagaagatactgtgcttagagggggaatatgttggaggctgtcacaaatatgctcaccccaacatctgagtgatcttaaattctgcaaacaaggaacaacaatggagtgagagaacaggcggcaggcagtgaatatttcatatgaaagtggagggcccattactggttctggtgggaccagaaatttgtgtacagcctccataaaataaaagttatatgatcctattcaataaggatctctgtaagaaggatcatttcaagtgcctgtaatagtcaggcacttttatgtcatttacatattttatttaattcttgcaaatggcctataagatagatattatctgtatttaagaaaaaaaaaaaaaaaacactgacattcaaagagttttagtgagagctaggactttgaacccagatctgcttggttctatttctaccacatttagaattaatgtagggccagaaaggacatgagcttatccttaaagcctacataacaaagtagattacgttataaagcatgtagtagttgccctgtatctgttagctgctgttgttcacaaatcatactgcaaattaccttggtgtatgaccaccagttgagacttttgccaataactactaaatgatttctcaattcttgtctagaaaaaaacacaagtgtatagtggtcctcagtccatcagataaatccctggtcagtttagacgctgcttaggcacttcagtgcaaacaccctattccttatattggtatcctggacgtcaacatgagcagaagtaccttggatcaccaaaggatcaagtcttccaagttatttataatggggaatttctcaaatttagtgttattgactactaaaggatactttggtgagtagacatgtctctcccaccttacttacatggtgaaagagttcaattacataattaatacaacagccaataatccaataccaggtgttttgacaagttagcatcacctgaatttaaaacctctatgaacaatctgcctataaaggcacgaagttctgaaaacattaacttactattgctgatgctctctaaatgcttctcttctaaggttttcttgaagtctttttttctcctccagtttattgctctgaaattgcaaatatcaaaacataacttattaaagatgctttaagcagagtcatgatgttaaagttacccaaggtccaaaatcctaaggttcaactggccttgatagtctaatacagtatcctgctagaggctccaagatggtactccctgtcagacccatgggcactgcactgaaagccaggagctccaagttctttccacagctcccctctcccaacttgattggtataatcacagaaccagcattttgcgtttttattctttagttcaaatgatagcaacatttattttttaagcagtgctttcaaaatgttttaatgaaaacatgaaatttccataccaagtatgttaaattaaaattataataaatggttaaacagctcatacaaaatttatacatacactcaaattctactaaagtatttgagaagagattttcagtaagacaacccaactcccttctgacttagtatcagatacttaaagctgttgagggactgaatagcacatgtcataaaaaaagccatccacttgaatagaaaatagttcttttttttaattagctgtttggagagcctggagataaaggccttcatatttgatattactgtcaccatggctctggcatattttaatccaatttaaataacccaggaatgtttgctttttgctcaccatgacacactgtcattttttaacttgctatgacctatgaaaaacaagtaaaattcctagacaacaaatttaatggagagttgaaacacattctactatccaggaggatcatgaagttttaaatgaatccaagagagacagtaaggagctggggttgctttaataaaaattggatttgcccagaagaggaccagtgaaaggagaatattggaaatcatcactttcaagcccaaacataagtctggttccatctttcaaagaaatgaagaaactgcttgtattgttcatttccatgaaagtcttcattcactcaaaactaattactagtcccattttgaaaggcaaaatggatgatgatttcagtttcagaaaaaaactaaaggaaatttactacagtcaaagaaaatcaattataaggcaagcaactggattattaatgaaacacagaattctaggaggcaaactaatggaaaattgtaaaaccaaataaacatgattctagtctaggaaaaaatcctgactgatgagcacaaaagtgttcaattgtgatgagttccctgccctccagggtggggactggggggtcgtggtggatctaaaagggtgaaagacagcaagcgagcagtaagtgttgattaaaccagtattcagaatgctactcagagaacagtgagaaagccaaaaacagctagagacaaaaggctggatccctttagcaaggttagaaattgagaccactgattttaaccttttcactaatagattccaactcacaaacagtcatacagtagctaaattttatccaacaaaagtctgtttatggcaggacgcggtgactcacgcctgtaatcccagatctttgggaggccgaggcgggcggatcatctgaggtcaggagttcaagaccagtctggccaacatggtgaaatctcatctctactaaaaatttaaaaattagccagtggtggtggcaggcacctgtagtccaagctactcgggaggctgaggtaggagaatcgcttgaactcgggaggcagaggttgcaatgagtcaagatcgtgccattgcactccagcctgggcgacaagagtgaaactccatctcagaagaaaaacaaaaaaaaacaaaaaatgtttgtttatgcctcagcagaagttgatagttgatgaagaagtatttggggggggggggaagtagtagtagtagtatttctggagtagttgaaaaattgtattcaatccctattcatatcaaatgcctgttatatgctcggtaccatgttagatgctgggaatacagctacgaacagagaagtgcccattctggaaaatgttacagcctcgttggggacacagacaaaaaagaaatgatggcagtatgctaaacacattaggggacagcagtttgcaaataacagtaagaatgcagaaaaagcacttatatggattgtcaggaaatgctctcaaaagttccacagtaactcaatgcctacttaatgttagactccatcctgagcacgagagccaagaagcggaataacactgggaatgtggtttctaactttgggtaagctgcatgttatgagggtgcttctttctatggagagtggactcacagctttcttcatattccccaaagagctgatgaccaaataaaaggataaataccatggctctaatgagagagagaaattctatatccaacccaatcttaagcaagagtgtttcaggaggaggagaaggtaggaacagggttactacactccattatatgggttgttcagcccatggggtcccagcaggcaggaggggagtaggaaaggaaaaatagagccagtgttcagctcaccaagatttgtactgcagcttgtggctgctttagcgcagaggaggtgtctttttctgtgtctcacaaaggcactatctatcaccagtctgagcacccacagaattgaccgcctggatggagaattggtctctaatttgcacaaaggcaaccatgggctggtagtaaccctggacaggaaaggggcattcccagaacttaacgtttttaatatacaaaggtacaagagaatatgttagctcaaggaaacccaagaagctcatggataaattgaacaacgtttatagagaaaggagtagaagataaggatgagaaagtaagaaggaataattatataggaatgtatgtgccaagtaaaggagtttggactttatgaaacccaacagtaagccattatattaagcaggaaaggaagtggctcactcttatagcaacatggaggttaaactgcagcaagggccacaaatacacgagaacccctggggtgattctcacagtaatctaggccataaattacaagccccaagttaagtcagcaggtacagggaagaaagaagaaaggacagtcttcagaaaaacttaaaggacagaaataataggaagcatgatgatagggatatgggatgagtaagaaaaggaggaagagtctaagattactatcatttaagagcaccagaatgaacatatgagttcaattttgaatttattggatttgaggtatacttgtggaatatttagggagaaatatcaagcatgcagcaaaatatatggttctggaatttagaaatatggtctggcctgaagatatggactgcagaaatcagtacaaacaataactagatccttaaatgtggaatttttcatctaaggagagggggcctaggcccagcagtatcagaggagaccacgggatgggatctggtaagcatcaatagtggaaaaacaagtacaaggaaaggatcccagagacattcaggaggtggaatttgaaggacagagtacttaatagttaattttaaattttaattttatttatgtatttatttatttgagacaaggtcttgctctgtcacccaggctgcagtgcagtggtgccatctgggctcactgcaacctctgcctcccaggttcaagtgatcctcatgcctcagcctcctgagtaactgggattacaggtacgtaccaccacacctggctaatatatgtgtttttgtagagatggggtctcaccatgtttcccaggctgctcttgaactcctgggatcaagcaattggcccgccttagctcccaaagtgctgggattgcaggcatgagccaccatacccagccttaatatttaattttacacagagcaaaaataagtgaggaatttaagaatctttactgggatcttttctttctttctttttaagagctggggtttcaccatcttgcccagactggtctcaaagccctgggctcaagcaatctttccttcttggcctcccagtgtcctgggattacaggcatgaatcactccgcccagctggatttttcagttaagaacaccgttggtgatcttaggtagattagaaccagagaagcattagaaacaaaagccaaattcagcccaccaacaaatgaggaatcagagaaggaaaggaatcagagaaggtaagttcttaagctagctgatccacacatctcctggggaacatttttttttttaaatagagattctttggttcaggtgattgtccacagactgacatttgggaaccaaatatggtagaggagtctttcaagaagttcgaaccataatgcttgggacagaggagttgaaagcagaccactatatggaaaatttgtttttaaggtgagagatttgagtaagattaaatcctgagaaagaaaaacaaaaacaaaacaaacaacaaaacaagaaagtgagaggagaaagggagcttaactgatagagaagcaaggtccctggggagaccggagggaagatgaaatggtgaacacatatggaagaatccatggtaccaatgaggaaaaggactttctgattcctcctgagataggatgggggtaggtgcagcaaagggagagtaagaaaagagaaaaataaagatacttaaggctggcaacctttatttcctatgaagtgagagacaaggtcacgtgctgcaaatgaaaggagagcataagaacataaagccagcaaggattttggtaattgggtttggttcccagttacaatgcaaagaaaaaaaatgctgggcattgggcattgtgaaagacccagctgagatcaaatctcagaaatgtagtgtggcaaaagaaaaaacaaaagtcacatatgtttttctctccagcaacttcattcatgtgggtttagtagaaatgaaataattgaacccatccaattcatgcataaaaataataatactctctacgccccccttccaagaggttgatataatagattccaacgagatagtgttaaagcacttctttacatttataattaggttagggtactttactgagtgcttaccaagtgctaggtattgtactaagggctgtgtatatattgcatcctctagtcctaccagtctcactattacattattatacccattttacaaataaggtaagtgaagcacagaaaagctatcagcctacactcttagtaccacatgtttattttagagatactaacattaccacattatggggttaattagcgagatcctattacatttcaataaccaaaggcttaatgcttccaccaagtcatccacaaagaaatgcatgatgtaggagccacatttcttggaaacactgatgttccctgaaagttttcagaaatggaaatgtttcccaatttatataaacaacattgaaataacttcctcaatgttgagtttacccctaaaattgttcttaaactgttagcccttgctactacttgcttcctagaaataagaaagcaacaagtgtgatcccttaacatgtacctgtatgcagctctgcatctaatatgcataacttattttctaccagttagttcctacttcaccgtatagcattaaaactaactgtgcttctcagtgtctgcatgaaacactgtgacttccagtgcttcaaatgactttcacagccatggcttactggaaagagcaaggaaaggtgttggaagccactcagatctttagctggtttcctgaattctctgaggttatgataccaagaggttggggaatcaaatgaagtatagttggtcctccttatctgtgagttccatatctgctgactcaaccaacttccgatggaaaatattcaggggatgaggaatagacggttgcatctatactgaatatgtaagactattttcttgtcattattccctaaacaatatagtataacaactatttacacaacatttacatcatattaggtattataaataatctagagatgacttaaagcatacaaaggatgtacatatgctattgcaaatactactccattttatataggattttggtatccattgtgttgtggggggagggggaggcagcaaccaatctcccatatctaaaggatggctgtatctggaaactatataataccgtatattatctcaaacatatgtagatcgaaggcagaataagatgaacccaggaaattgagagagtctttaaaatggagttagaagattttcatattttaggtttgtgggtattatgaaagtctgggaaaataaaattattatttatcatgtgattatggggggaaaatgtgatttactcccatagcactaaatttgggtgaaatgcttgctgtggggagttaggaaaacctgtctatttatactgaaagaaccagtggcaaaacacttgcatctggtagactgcttttttactctaatgctctaatgtcttagagacgttgtctctgctttatagatttcttggaaaagaaattaatgcatcattataaaaccacatgagtagtattagtttcctattgctggtataataaattaccacaaagttaacagcttaaaacaatacaaatttattatcttacagctctggaggtcagaagtacaaaacgggtatcaatgggctaaaatcaaggtgccagaaaggctgtgttccttctggaggctcaaagggaaataatcagtttcctggtcttttccagcttctagaggctacccacattcctgggctaatggccccttcctacatcttcaaagccagcagtggtgggctgagtctttctcctggtatcatctcttcattctctatctccctctcccaattttaaggacctctgtgattatattgggcacctggatattgcaggatacgctctctattttaaggtcagttgattagcaaccctaattccacctgtgaccttaatccccttacccatgtaaggaaacatgttcctaggttccagggataaaacgtggacatcttggggtggagcattattctgcccactacatgaattataatctatttttaaatcaataaatatcatacacacaataggccagctatttccccaaatctttactctccctagccctctgaggtttggctttagaatatgggtggtaggggagggtaagaaaatacctttttcatttagtgctaagcagtggtgtgctggtcaacatttaatcaggtctagcaggtaggagcaggaggggaaattaatctgtagcatttactgatttccacatcgtaaatattttccaccacagtcggtttcaaactgacaatgatgaagccaagtagctcaaaaaaatcctgaaaatgtgacaattcccacagtacaaggcagtacaaggaagctacagaacatcactagaagtatatatactgtgacagactctagtctagggaatgcaagttacattcctgaactgaatacaactcaagtataccagtgctgtctccaaatttccctttgtacccataggattaactcttcctgggccccactgacatgactggatactaaagagctggttgactttcacacctgtctgtctattaaggatcaaagaacatgcacaaatgctggcaaggaatccagtctattcttccctcactaaatgctgcacacagagatgacgaccaatcagaatgagacccagtgtcccctgacttcttttgggagagaaggaaatgaagggcagaaggggaccagcagccagtgggggaagaccagagacaaggctagaggctcttgggtggcaataggctgcttggattctacttggctcagagtttactgggcagcagccatttgcctggggaggagggcagcgtgtttgcaggctgatgtccatgtgtgtgtttgctgtgcattttaaaatataagtgctccataagcacagccattatcacttccctcggccatttccacactggcaatgtgaaatatgtcatttctagatggctaatgttcatttttcttatctgacacaagctactaactaggctcacatttaacatgaaaagctacagatttatctacaacagggaaggctaggatcatggtgacagtgcaggccaatcagccagagaaatcacatctgtggaagaacaaggatgggtcaccccttcttttgcaaggtcatttaaatttatgctcctcgagcttttatgtgcacaggaattacctggggagcttgttaaaatgcagattctgattcggtaggtctgaggtagggctcaagattctgctcttctaacaaactcccagatgatgccaatggtgcttgttcaagggccatattttcaatgggaagggtctacagatcaactctctctccccatctctcacatcctggcaaatttatgccaacagaattacagttatcatattaggaaagggaaaaacactacttttagacaatgtttaaacagtttaggccaggcatggtggctcattcctgtaatcccagcactttgggaggccaaggcaggtggatcccttgagcccaagagttcgagaccagccttggcaacatggtgaaaccctccctgtctctacaaaaaatacaaaaaaaaaaaaaaaatagctatagtggtgttaacctgtagtcccagctactcaggaggctgaggtgggaggactgcctgaccccaggagactgaggctgcagtgagctgtgatcacaccactgcactccagcctgtgcaacagagtgagaccccgtctcaaaaaaaaaagaaaggaaacagtttcaaccacaaacatttatgaatagcgtacattattgacccatgaagaaattagctgtaaatgacccacacgccagccaatgatgggtattaaatgacaacgaataaatgatctttaggacaagaggttgcaatacaataattattaagggtctgcaagcctcttcaccctgttcctggtgatgacttaacaattgtctttgttctacctgaaatacaggctatgctccgtaaagagagtgcctcctctagaatcacaagacctaagcatgaatcttcctttgaaggataaaatggaaggaaaaaaactggatgaggaaaagaagagtggggaatagaaagagagagagagagaaagatggataaatttttaaagttactataataaaaatcttctacaacgaaactataattgttgatcagcaaatgtgaactaatcctcctcctccttaccttctctctctgaattgccttcattttttggagttcagcttcttcagcttccttcttgattcttacagattcttctctttttagctaaattgtattgaaattacagagaacaaaaacagttaccatttttcagtctgaactctggaacacaaaattatgatgaaaggcaaattacagtattgtttgtgctatacctcaccatgattataggttgttacttcaagctacttagatcacagagaatggccgggctacgtcttctgcccgtgaaatttctgtctttgtgtttcttccttggtctgtctctttttcaacgtctctgtctttgtctatctctgtctctctctgtgtgtatgtgtgtgtggtgtgtgtgtgtattggggagggaaaagggaaaataatttttcctgattacaaaactcagtgttcattgtaaaaatcgctgggaatcttaaatattttttgtactacttccatgactgccatgcagtaaacaaatccatattcttagaaccaaaacattccaaacatagtagactttaaactatagttaaacatagttaacttaaatgaaaaaaataattcccttaatcgagggtcatgctgagtgataaagggcttaggtaggaattgaaggtatccatctcttcacttctcacttcctgagagctttgattctgaaagctgccttttgcaactggttggaaggttttatacttttggtaaagttactgtgttatttcacagttacttgtaagagctggtactcatattccttaccaaaattcaactaaaagagatgaattctgaccttttgcttgtatttagattgcatcagctggagttgttgtttctgtctgacttcagtttctgactggcttccaccttaggaaaaaaaaatccatgaaggtgaaacataaatattaagctgaaatgtcagccatcgaggactaattaatatataataaatctataacatgagttcccttaacattctcatgctcttgcaaataagaacataaccagttttccaagaagaccttaaagaaggggaatcacttagaagaaagagctggatagaaagaggagaccatatttttaaaacaaaagagcacttttactaaggtttttcaatcatgtaggtattaaagttttcacttggattgaaatcatacctaaaggtctgtgctaaacagaagaaatagtgcctgtcttggaaactgtagaatattcctcctgcttgaatatgaccatgcccgaacctagtaaagatggtgatcaaaggtgcttctattgcttttcttcttctaactctattgccttatattcaagcagcaaggctcaggaggctctcagaggtcttgccactagacaagcatgtagtctttataacccagtttctaaaaatacaatgggaatattctagttagtaactgatcatcaatccatactatttattgttctttccttatatagtcaaaataaaaatatggatgttagattatttacttgctctctcttaaacctaaaagaatttggggccagaaatcctggcagcttgacaatcatctaagaattaccatttagggaattctcagtgtttatgcaagcttggtgtgcgtattataaagattcctttgaaataattctctggtgctttggtcactaaaagtgtcagctctctgaaagattcactctcacagaagatgcattaaaacaatttgtgttcactataaatcttataattgaactgagaaagataccatagggacttttcttctgagatctgaaagatatataaggcctgtttggtgttggccctttgactgctattgtgggggatgggggatgtttctttcaaaacagtaaggaatgttgacatttttctctaatgttacagcaacttttagtatctcctgcaaccattccaatattgtaaggggtagagaaatagaggaggagttgaaaattagaagaaatggagagagccagatgtctaagcatttacaagttttgttcaaaactcatctcaaagtttaatacattctagaattttcttttctacccccaagtccctcccacacacacatacctgactaaccctagataatgcatataacaggaagtcaaaatgagaatcctgctcattttctgctaaggcttcaagacaacagatgccgagcgcttcaaattccaaagggaggtaatggcccctcaaagcaggatctgcaaggaggtaactgaaacctaccttggggaaccttaactaacttcagcctataaaagaggttggttaggtcaaagggaggcagaaatctgaggaaagatgtcattctgaattctatgtcttctgtgttttgaggaaggagaaatcttcacaccagatgagcaggagaagtttaatgaaaatcagctggagtccctgtccctctccctctccctctccctctccctctccctctccctctccctctccctcgtctccctctccctcgtctccctctccctctccctcctctccctctccctctccctctccctctccctctccctcgtctccctctccccacggtctccctctcatgcggagccgaagctggactgtactgctgccatctcggctcactgcaacctccctgcctgattctcctgcctcagtctgccgaatgcctgcaattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacgcctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcatctccgcccggccgccatcccatctaggaagtgaggagcgcctcttcccagccgccatcacatttaggaagtgaggagcgtctctgcccggccgcccatcgtctgaaatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccgccccgtctgagaagtgaggagcccctccgcccggcagctgccccgtctgagaagtgaggagcctctccgcccggcagccaccccatctgggaagtaaggagcgtctccgcccggcagccaccccggccgggagggaggtgggggggtcagccccccgcccggccagccgccccgtccgggaggtgaggggcgcctccgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggaatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagaaaatcagctggagacctcaacctgcatttttaagagtctgagggtcttattggattcatgcctagaacagttagagcctaaaggtataaggctgttgtccattggccactgagatgagtcctcaagaagaggtagctacattacaaatggcccacattcacagtttatgaaaagaaagaatgcacaagtatttcctgtacttttaatgtgattctcatgaaagagaatgccaacctaaagccatctaaagggacttgcctatgagggccatgtcaagaacaatggaaccctaaaaggagtctaccaagagccaacagtgaggccaagccctgccgacaggagaggaaatcgtctgtatcagggaaatccaggtgggagatgggtagcagagagtgggggatgctgaaaaactcgaagattcccaggaagaagaacgagcagtcagtgtaaacctaggctcaaagaaacaaggatcactgcattacgaaccccgaactctcttatctccctccacttcccccttcaatcccagaaaggtcagaatctgggaacagagccatgaatagagaaaagtccagccacaccctgttctacttgctggattcctacctgaaacaggcctgggttagagcaggggagaagctctcatctccattagtaacagaattttgatcagtacctaagactgaacattaattactgaaatgagactgttttaggcctagaattagctaggtcactctactgtttgaaagagaccaaaaagctttaatttcttacatcatccaaaaagcctgagaaagactgttctcacatagccaatctcaggggccaagctaggaaagattaaagctgttttctgattgtacccttcgagtctggctcatttgcacaaaggaggcacttgagattagcccttttcacgaaatacagtgggatgatgataatattactattacttcctcccattaaataatttccaaattagattatttttacctatgttcttggtgggggggcagggtgtggggagggaacttctctaaaactatcacaaccgtaagtggcccctgacacaagacatgcttgtattaactaaatctgtggacactgtgtgtccaaccctttaaattttcggctgctgatagaagagaaaaagcaaagaaaagatgtgaatgattcccattaggtggcatcccttctgaatgattcaaacaccggcaaaggcggcccagacaattcatcacactggcagcacctgctccagaggcccagaggtctctatctgtagaataaaaacacaggtgatgtttctcttatacccaccaccgggtttccagctcactctcatctccctcttggaactgactctccactccttttcttcagattaacatttaactgccatgattaatatgcttgtgccagcatttactcccatcctgactagtgctatgacagggcatatgcagcgccccaggtaagctttttcagagtcaatcatctaagaggctctaaattatttggcaattaagccatcactgtgttcccatagaactctggcattacaggtttgctacttgcagaaaatcagaaaaaaaaaaaaatacacacacacacacacacacacacacacacacaattaaatgcattccacccaagcagcacaatgaccaaacaaactacaatggacattcacagacagacatatgcaagctgcttacaggatccataggtggccccgccctccctcattccggcagcggctgtgcttgcttacctagccgtctgggcaccaggtgaaccggtttagctctgttctgctccttccacttctccaggttggccagctcctgctccgcaactaagccaggcgagaaatatcaaatcgtcaattattagacttctaaaagaaaaccagtcccttcaaagcataagaaacaactattagaaggcaattaactatatgtgagcatgagtgaacaaggcttccaggttagaaacacaatattcagccctgacccgtacaggtcatcctgggcccggccctgtggcacattctcaccaagagtcagcacagagggttcgaatttgaaaaaccacctgggctcctactaaaagaagtatagattttcctaccattctggcatttttaaaactctatatcaagttaatttttaaagttacctatagaaaatgtgtgcaaaactagaatattttcacgtcaataagaactttccacacataggtaaacatatccccagagaattctgatgcccatactcgctttatcttcaatgctcccaagcttactgcgactctagggaatgagggctcggtgctacaggtggagacccttgctctggtttcaggcactccagaccactgtgcagagtcggcttcctggggagcagggctcatttcctaaatgttcactctgcacgacagcagggggcgccagagagaaattagttctgtcactccagcgcctccccttatctcctcatgagacctgtttcaaatgtccattactagaaaaacaaattctgaaacatttcgaaatccagaccacattgagacttaatctcctattaagtatttaaatcaaaagcttgtaagataccagaactgctggcagttcccatagtccctgcatggctgtgattgtcatattctgcactgacccgctgtcccacccggagctacatgtccggtggagactctttagagagctttttcccttttgtgcctttctgtccatcattagtcatgaagttaaatttcctaccaatcatgtaataaaggagaccatcgaatttcagcatagccccacagctggacttgagcaagcctacaatttctttgtgaactaaatgaactttagttctcttccacctctaaaggataatgctataactttaaatggcagcatttatatttactgtacatcaattaaacatgttatgtacgcattaagtacagagagcacaaaaacgagtaagatgtggtccctaccctcaaggaggtttattggcaataagtgtaaagttgttcaagccaacagaaatccaggatctaccatcatgtcatgagttctgttactaacgtagagaaacaaacttagaagtgttaatagtagaatatttttaaaggtataatcaaaactaaaaaaaacaaaaaaccttgatgagatttggtgagtctatataaatgagaaaataaaaatacttcacaccaaaacaaaccaattgtaaaaagagagaagcattctgaatgttaaatgaatgactatacatacttctttgtatctcatttctccggtttatatttggtgctatcaaggtgtatgcacttgtgctaaaaggaagagaaaaaaaaatgcttattaccatgagaaactaccaatgcatataagccaccagatatttttccttctattatactgtatttatgatcattaccatcaaataggcactatgaaagataatcttcttaagaccctgatctgttctctgggacctcacaatcttgatgtcaaagtaaaacaaaggacatggccaaatatgaaaatataaagcattcgatgagtgacaagtgactagttggtgtactgtccttgtagggctccaccgttcctctaggtggtgcttgtgagtaaattcctttaagatggctttagattggcattctcttctgtgtgaccacaccggggtacaggaaacattggtacattttctgttcccacagactgatcctagaggccatttgcaatgcagccacctcctcttgatgatctgagtaactaactggcttttaggctttgacttttctaggcctatgtccactggtctcttcttctcctagggacacaggttgagcataatcaggggctcggagaagcaaggagtcatttcaaccaggcggatcagggaagactttttaagaaaaatattcacctctgtgacactaggaagctgttaaaatattgtgagcttttgagggcagagagtgtgcttgattgatgtgtattccaagcccctggcacagtgtctggcacaaagacattggctgcttgataaatgtgggctgaattaaaacaaaatgatgctacagacccagcctgtgagtctgtgtgggggtggctcttttttgagatgatgcacgtgatcccacaagaacatgaatactccattaagcaataatatagcacagcaacagactgcagcatacatgtaggtacagttttaagagaaatgctgtggataaacacaaccagcttctaactgtaggatttaagagggagggaaaaaaccccacccagatactcttggaagtctctctcttctacctgaatacacaatttcaaagggcaaattagcaaagattgaactgtagaggccaaaagcactgatcaacagaagccatttccttccttatctcattatttttctagcagctagccttcagccagcttcaaactgggctttaattttagacttgtaaatgtgaggtgtgcaacagcctttgcatgcaaatggggctgctggatgcccaattacttaatgtatatcagcagacgttgcatgtgtagcctagcatgcatacaacgttatgaatacaaaattaggagactgccactggcaattaatcccttgtccattgcacattctttgtacaccctaagaaacatttttcacttctgaattgccagtactttttaggagcttggaagctacaatcccgtgggtagtccctggaaacttgaatatgatgcaatggtgagccatgctacagagactgaaagctgaaacatcagatacgagacgtaaatgccaatcatgaaattgctacacaatcttcaatgtctgctaacattgtggtatagagcttctctctataccacaaatttgactatactccagatcagtagttctcagcctttatcgtgcatcataatcaccaggagggcttgtccgcgagcttgagagtttctaattcagtagcctgcgactgggtcaaataacttacatttttaacaagttccaagatgatgctgttcttgatctaggtaccacacttggaaaaccactactatagagcaatcaagctatcttagaacatttgggataaaagaaaacttaggtattcataaatcactggtaaagacacagaggttgaatctcaggccaaagatcaccaggtcaattgagcaacactgatgagactccagtctaagacttttgacttagatcagttttctgtctgcagctaacttttcaactcaatgtgcaaagcataaaatatgaccatcctttaactttagtcccttgatagacttccaaacaatgcaacctacttaactgggcacttattatggatttattgtattaggggcttgtagagagtgaggggagattccagaacagggatactaatcactttaacagaacttacactttagttaggaacaagtcaagaaaccacaaaagcaccccacgagaatatccaaccactcaacatgagttctggatggggaaaaaaacaaaaataaataaataaaaaataaattaaaaaagaatacccaaacaagtcttaaagtgggaatgatgtaagtactcagagatccaaaacagtggagattcatagagacctcagaagagtaaaaaactgaatagcacgaaataagaatagtaagttgaggcttaaagaataggatctgaaatagcaaaagtgtttctttgccaggactttgccaaaagcagcttcacagagaattttccaagtccatgagtctctcttacggaaattttgcaaaaggtttggagagaaaaatcaactcatttgtaaaagattgtattctacaatatctaatctggttaagtttttaagtccgacatcatactagaatcttccatcttaagaataggacttcagtcaatctatggccaatgtgtgtagcttacaggtacctaatagagaaacataaaataaagggaaagaattagctctgaatttagagggtttttactgaaagcattttagcataaacccaggcagtggtcccagtaataaacgttttatgtaaattttatgtgaattgctcagcaaccttctcagcaatattttattgactgaaaatgccaaatctgaaacatgttataatagtcccaagaaagcattgccaagtaaatggtaaggaacttagcttctatttctatttcttaatataagaagaagagcttaagtcaaaggatatgctttttattttttaatatcatgtgtcagagtgtaatgccttagtagatacaaatattcatcccttctttcttagctttctcttgacatgaagagcaagtataatttattaatgttttcagccaattagtttgtacccacagcaaaggcctttgctgttttaacctatgtgctatctcttccaacagcctgactctcaaagttgctaatctagacaagcccaacaaccaacatttcgcattcttgtcatttcctgattaagcaacattcaagccactgaaataaatatatatatttgaaaatgagtctccttaattacctcattgaaatttaatgaaagatctcaatttgtaagattattttcactttccaacagcgcacatccgtgagatatactgagggagaatatatgaaagaacagacaagataaaatgtttttctgcaccataagaaacataaaataaaaagatattcaagaaatgtttggccaagcgcggtggctcatgcctgtaatctcagcactttggggggctgaggcgggtggatcacttgaggtcaggagttcaagaccagcctggccaacatggtaaaaccctgtctctactaaaaatacaaaaattagccgggtgtgatagcacacgcctgtaatcccagctactcgggatgctgaggcaggagaatcgcttgatcccagggggcagaggttgcagtgagctgcgatcatgccactgcactccagcctggccgataacagtgaaactctgtctcaaaaaaaaagaaaaagaaaaagaaaagaaatgttttcctggccgggcgcggtggctcacgcctgtaatcccagcactttgggaggccagggcgggcggatcacgaggtcaggagattgagaccatcctggctaacacggtgaaaccccgtctctactaaaaatacaaaaaaaattagccgggcgtggtggtgggcgcctatagttccagctacttgggaggctgaggcaggagaatggcgtgaaccagggaggcggagcttgcagtgagccgagattgcgccactgcactcccgcctgggcgacagagcaagactccgtctcaaaaaaaaaaaaaaaagttttccttgcgaggtctctcgagttacacaactgcatcttgtgtgtacattcttgcacaatttttataactttttatcaataagtactctgaaaaaatgttatgttgaagttatcaaaaatatcttggctggctaaaagtattacataacaatatcccctggtgtgtacaaactgcaccagatgtaatttaaatttgtaattaggagcaacactggtttgacagaaaaagaaatgcagttaagagcaaaagttcggaaagagaaaattaagtgaaaaacataatttcaagcagaatagtagacatgtaaagtctacagtcctgcaaaaagttgaagttttcatagttcaagaaaatcttatccttgggtatatataaattgaaaaaaaaagacttagagataatcaaaggcatttcgatacttatctttccagataagacattccatattggtttttgttacatgaccttcaatgtaagaatcagaaacttactgttttcagtcaacattgagtcaaaacttttgaggcatttaggtttccaaaagtttgttcatacatagatcaaattcccaagaataatagaaaatgacaagaccaggccgagcgaattacccttgacccctaagcctatattataccacccctgatcaagtattccacatctccagtgtggaaacatttatgaattgtctttggcctcagaaactacagaggctaagatactgtctgcacacccaagaagctgatgtgtaattgattagttctttcatcagcacaactcattgcctctgttagacggctgaatacagacacagtgggtaaagacagataaataagcaggaaatcatcggggcctttgtttataggatgcctttaagaaaatgagaggcatacacacccaggatccccatggcttactgagatattgtaaattcatgcaaactagaaaaaaagtgctgcttctttcaggtggaggtaatcccacactaagatacatggtttggtatgtatctcagccacaaatcacaccttagctgggcaagtgtgtgtagtcaccaatctgcacaaccatatagaatcgacctgagatgatgtatttcttcacttaaacacacacacacacataagtaaaagccacacaaaaaaaagttagcaagaaggagtcacactaaagatataaagagtgtatatgaagtacaatattgtagagactcaccatctttaagaggccaaaaaccaatgatgggaccatcgttgagatggagaccaactggtaggtatacttacaaaatgtcttgtaactacttcctcagtaaaaataactgtcagaaattcatattttcagaacatagagatgtcaggtctgggatttgattggattccacttacaagctaataagttagcctgttactgtttcacagacactggcagaagacatgaaattcctggatcagagtcaaagactttattactgatggcacagtaggcagcatgagcaccagcttatttacatctattctctctggcctccagtcttatgatgggcgcaacaggatggatgctgcacacatggtgtgtttgcattgcagctgataaaatccttcgggaatacaccatttttacagcagatagtaagtgagcctggtctttgtcctgggagaacaaaccttatctctcaaggttcccagctaaataaataactctaagaaataggttaaagagtggtcttggcacatccaacaaaacgtaagtgtacctgaggccctagggggactctcttttccagcaagagaatatttagtattaacattcatattaagaatggcttaatgataaataaattgatattggcagaaaaaccacttacttatgaaatgtgctatatattttctcttcccattattattattaatagacttagaatggattatgtttctgtctcaagccttactcaaggttatctataacttaaaggaaaaaaccagaaatgcaagacatagtgatgtactccaaaatctgtacatagaacacttagaaatgaaattcatgttttctgattttgaaagaaacatacttgtaaaagaaaattcagaaaactattttaaaaacatttaaaagtcacatataatcccacctctcaaacaccacaattacaattttatttgggtgaatttacttttcatctatgctctatacatattattacacagttgcaaacatattttaagtacagctgtacatcctgctttcatttataagtggttttcctaatttgattatatatgtaacatgcttaattctcaatggctatgtagtatttcatgatattggtgcatcatataaccactcaactattgcaactgtttcaattattcactattataaataatcctacaggatgtacaaagcataatgctttcagcagaacattatccagaagaaaacactaacagtcctctgaattcaatactctgaacaggaatgtgggctacatttaaacttttcttccttagatatcctatttacatttcaaaaatctgagacaacataatcatatgattaatttccactcttatgtgtgacatcctttattctttaaccaaaagagatgtaggccctacccaacattcactctcacttcctccttgctaatagcacttctgtattattcagacagagaatgtgcccaattaaaagactacagccaccaaccttctgtatagttaggtaaaattatgtgattaagtttgagaaattgagacataagtggaagtcacggagagagatttctagaaagcctcctttaagtggtggtagacaaatagaaaaagctgttttgttactttccttcttcctggaaggttgatgtggtagctggtgctcaagcaaccatcttagtcaatgaggcaacctgaatatggaagacatgatcaggaatggcagagcagaaagtcagaagcagtctggtgctctgtgaccatgaaaacaccacatcagtggtaatccgttgctgtactgcccaacttcaaaccctaattctgttatttcctatctgtacaactttgagcagattattcagtttttctattttttcacctgtgaaatcgggataactatccacttcataggatataaagtgctgtgaaccctgaatatctgaggcaggcctcagttaatttataaagtttaaaggcctggtgtggtggctcatgcctgtaatcccagcactttgggaggccgtggcaggcagatcacgaggtcaggagatcgagaccatcctggctaacacggtgaaaccccatcactactaaaaatacaaaaaaaaattagctgggtgtagtggcgggcgcctgtagtcccagctacttgggaggctgaggcaggagaatggcgtgaacccgggaggcggagcttgcagtgagccaagatcacgccactgcactccagcctgggccacagagcgagactccatctcaaaaaaaaaaaagaaagtttattttgccaaggttgaggacgcacccatgacacagcttcaagaggccctgatgacatgtggtctaggtggtcagagtacagtttggttttagacattttaggaagacatgagacatcaaacaacatatgtaagatgaacattggtttagtccagaaaggcaggacaactggaagcaaaggtgggacaacgcatagcggggagggggcttccaggtcataataaataagagacaaacagttgcattcttttgagtttctgattcgcctttccaaagaaggcaatcagatatgcatttatctcagtgagcagagggctgactttgaatagaatgcaaggcaggtttgccctgagcagttcccagcttgacttttccctttagcttagtgatttggggaccccaggatttcttttcatttcacagttctgagaacaatgccagaaaataacaaatattctattatagttttccattatttgtattagatcatccctagactacctaccttcagacttattttatgggagagaaataaagaaagccatagatacttacttaagataactaaggggacatctattgcattgtatgtaattataacaactatatataacatatatgacatctattttatatgtaacaacttagccctgaatcactaggacatctcctttcttcatgctgtgactgattccctttgctgcatcttctttcataaatatatatcattaagttttttctaattatttctttatatccctgtttctggctcttccttttaacaactgtatcctggttcctgattctttcctttgaataataaggaccactgcatgaaacaaagtagtatttataaataatacatcttaaaaattagtacatattttttctcctgtaaatggtagcatgattctgagcccaggcttttttcattaaattatgtattaacgtataacgtaactacagaaaacggcacaaattttaagcatacagcttcataagaaaagttcttttacattctccaggttccaaaagagaaaaggaaaaaaataacaataggcacaatgagctttagaatatcacctaaaattgtatttcccccaatgttttaagaaattttaagccggtggggcacagtggcttatgcctgtaatcccagcactttgggagactgaggcgggtggatcacgaggtcaggagatggagaccatcctggctaacacggcgaagccccgtctctactaaaaatacaaaaaaaaaattagccgggcgtggtggcgggtgcctgtagtcccagctactcaggaggctgaggcaggagaatggcgtgaacccggaaggcggcggagcttgcagtgagccgatatcgcgccgctggactccagcctgggcgacagagggagactccgtctcaaaaaaaaaaaaaaaaaagaaaagaaaagaaattttaagcctaacaagcaaagttatatattattaaaatgaatatccatatactgtttacttatatttaccaactgttaatgttttcccacatttgctttttctcttttaaccatatgaaaataagctgcagggtcataacacatcatccctaaatattttagcatgtatctcctaaaaataaaaacagtctcctacttaaatataataccattatcacaccaagaaatttaacattaatattgcctaatagtctatattcaaatttccaaattgtttccattttaatattcttccctacctttacctcatcctagatccaattatggattacacatttctatggtttgacatgtgtttgtagactcctatgagctcagacaatttccttgactttttttttctttctttcatgactgacatatttgaagagttcaggtaacttttcttatagaatgcttcacaatctggatgtaaggaaaagattatttcctcatgattcgattaggttaaacatttttagaaagaatactagataagacatgttatccaagatgccactgtgagaacaaaggttgtttccttgtgcaactaaataataagccaaagtgaaaaacaagatccgtctatatgatggagtgcaatcacagtttaaaacaaagattagaaaaagagtatctgtcacattctattggcaatagaaatcaaagggcattgtattagtccattctcatgctgctaataaagacatacttgagactgggtgatttataaagaaaaagaggtttaatggactcacagttccacatggctggggaggcctcacaatcatggtggaaggcaaaggaggagcaaaggcacatcttacatggtggcaggcaagagagcacgtgcagaggaactgccctttataaaaccatcaggtctcataaaacttactcactttcgagaacagcacaggaaaaaacagcccccataattcaattacctcccatgggtccctcccacaatacatggtgattatgggagctacaattcaagatgagatttgggtggggacacagccaaaccatattaggcatcatggccctaggttttctacttggaataaagagtcaaagagtgcaatctgtactttagagatttctttacactaaactctttgaagtgtttatttctaagggtcagaattgcaggggactttcacattctgtattatttttgaaatgtttgagtttttataacaagcagatatgactttacttttataatcagagaaacatattctgaagatttttaatagagaaatatttaatataaagatttcttatagcaggggctcagcttttcttacaagattaggtagcataggtttctgctttcactagtaccatagtaaaacaaacaatgggcaatactagcccttgagttttaatgatggtaaacatcttcagtttttctacaggactttaatggattttcttttaagtcttcatatttgcagggggtgggggacagggaattacaaacattacagaacaaaggaaccatcatcagccgattctctgatatagaatagacccttcaaatgcagtcatctccctttgattattttctttcctcttaagcttttgtttcagattcaaatacattctgaatagatgcaattaaccttaatatgtataaccttacagcactctactgactttgaagtaagtaaccttactgtgtaattgaactaagtttctttctcatttctgctatggttctactgattattgttagtaatatgttttcaagctttcatcatcctgttgatttattgtttcaccgttccagctgccaaagactttttagcaattcccattcatttttggtgatattgtatttgaacaaaaatgattgctccccaaggcttggcagaccacaaatgcgtaccatactgaggaatggaatccagtgcagaaaagttggaaattccttctaaacaggaccataatttctaccgtcctgcacaaacaggaatgtaaatttgatctaatcaaaccaaaatgtttttttcttttcatccactctgtctcttctgccatgcatagaactgtgcttttcaaactgtaggaggtaaccctctaatgggttatgaaatcaattcagtggatttatttttaatgaacaagaatagaaactgtcagagtacatcacatataataaaggtgaaaattgttttgtgaaattttttcagttatatataccctaatatatactcagtcaggtactaggtcatgatgtcaaatgaattgctcactgcaggctatgatcagaagtctgaaaaaaaaatcactgtaagttactatgttgttgaggttgcacagtgagagtgagataactgctctaatgtcagaggtgtttgaaccagagagattccaccttgaataggggctgggtaaaataaagctaaaacctgctgggctgcattcccagacagttaaggcattctaagtcacaggatgagataggaggttggcacaagatacaggtcctaaagaccttgctgataagacagttttcagtaaagaagccagctaaaacccaccaaaaccaagatggcaacgagagtgacctctggttttcctcaaagctacactcccaccagcaccatgacagtttacaaatgccatggcaacatcaggaagttaccctagatggtctaaagaggggaagcatgaataacccaccccttgtttagcataaaattaagaaataaccataaaaatgggcaaccagcaagccttggggctgctctgcctatggagtagtcactctttattcctttactttcttaataaacttgctctcactttgctctatagacttgccctgaattatttcttgtgtaacatccaagaaccttctcttggggtccggatcaggaccccttgccagtaacactaacacaaggctaccaagctcacctgtcatttgtgaaaagcagcagaacaaagggaatccccagagaaacttttctcctgcaaagtacttctctattcaaatcattttaaagctatgatggggttcacgacatgttatcccaaaatatagcaccttggtatttgagaaaacagcaaaaggaggaaagcctctctgaccttctcccatctttttcccctgaagcaagccataaaaaatttctctgaccttcctctaaggtaggtcataatatcctcatttcagagggatcctccctcctccctaaacccataggaaagaagtggagacatagagacacaaagaatttgaacaaacaggacttgctaagcttccccagtttatgtcattagaccatactcctttttgaccaatcatacttctatatactatccactcttcatcaaacctaagcataaaaagacacagttttccctggttctttgaatcttcatttttggatgctcctatgtcctataaaacttatgttaaatgaatgggtatgcttttctcttgttaatctgtctttttttatagggatatcagccatgaacctagggataggtaaggaaagaaatcttcccctctctgcaactgtaaatgtcacattactgcttcgatattaccactctctttagcctatagaacttctcttttcttaatgtcaatataaaacaatgatagggctgggcgcagtggctcatgcctgtaatctcagcactttgggaggccaaggcaggtggatcacgaggtcagcagttcaagaccagcctggccaacatggtgaaaccacgtctctactaaaaatacaaaaattagccaggcatggtggtggacacctgtaatcccagctactcgagaggctgaggcaggggaatcgcttgaagccaggaggcggagtttgcagtgagctgagaccacgccattgtactccagcctgggcaacagagcgagactccatctcaaaaaaaaaaaaaaaaaaaaaaaaaacaatgataagaccttagctagctgtactatcaatccttctatctattctccatctgtacatcatattcaagatccaaaatttggtagatagacataggtttgaatactggttctgtcactcaaaaagccatgagatcttggaaaatcattttattttcaagactcagtttcctcatctttaaggtagcaaatggcttatcatgaaaagaatattcaataatgtacctgacatacttaacacaaggtctagcacatggctaatcatggaaaacacatgagctactaattgttattttggttttagtctctcaggggtacccagtttaatttttccagatcataactaatttactttatgctacaacaggattccaatgcttcattacatttctcatttcaaaaataagtcaaatagtagtagtattagtatctgataatcattgagacatctacccagctcattgagacatgtcattaggaagagttaaatactatctgttgctttataaactttctgcatgctagagattgacttaaataatcccctaatgaataaccatctatattgagccatcaagattactcattacaatcaatcacagatactatcttccaatgtactattatttcataacattaaaaggaactccagcattacccaattctccatctccagggaagaatactagactgatgcattcaggccacttagcatctataagcagaattttattctcataatcatatagagaaggaaattgaacatctgaacattgcagtgaggaagaaatagtgaaaacagttctaatatgctctaataagtttgttaaaacttgtacttcatttcagaatattttatgtggcttattcagatgcaaataatgtgagtcaaaatgacttaagttctgtctcagacataagaaaccatacttcaggattgcagaaaatagacactaaatagtgatattgataaaaatttaacactataacttagtgactttattattgtatatcccaccttgtattccatcttataattacaaaatactttacaaaatttaacaatgctttttaaggagaaaagagaaaaatcaggattggccatgatgaactgctcttatcaaaccatcatttattctccttttatctcccttgagagtttggggatgaagagaaggattacaaagattatttccttccctcaagcataacaaactggtgggacgcattaaggttggatcaaggaaattaggaaatgtttttctgggccctgaaggaggaaatgagaaaaagaatgggtttccccaatctgcatagacagcatgccaacaacagacataaataagatgtctaagtgttgaggttgcagtagggtgttttagagactgtattagtttgagtccttcagaagctgacaccaagatggggttagacaagcaagagatggataagggggaatgcttgtgaaggatgaaagtgggagcaggggtagggaaggaaagctttgagaacaagactaggtctgattactattgccaaaacctaaataaaagacagtgagagaggccctcccaaagaaaatcatatttattctggattgagcattgcaatgggaatacagtgggtatattcaagaaggcaaaggaagacaaaggttttttaaggaaaagtgaggaaaggagggtgatacaagttgtttgagacaaatatccttggctacaaaaatcaacaagggtagaatcagtccaaggctggacagacagttgctaggcagatgtccttgcagaagtactttttgtgtaaggttgtagcttttgtgcaaagttgtagtttttgcagagccttttgtgagagttcttgttatgaggcatatgtgcatgagaatcttcccttcatggccccagctccacgtgtttgacacaagtgacctcattttgagtctgacaactttcattctatgaaaggaccgaaggaaagaggattgagtagcaagatcctcagtgttatacagttctgagaaaatcttggacacgaatatggggagtcttccagcaaaagttgcctaatagaggagttctgcatgggccaggaataggctagcactaaaaccatcccaagaaaattgtataaaattgagcaagagaaaaacaaaacaataaaatccaaccgggcttgcagcagcaatcattaagccagcttgccctttggtccacttccttgtagctggttgttgctcactagcccagctttgagctgtccaatggacaaccccagattttctagcccctcaccctccatgaatccccttaaaaacccttgcccagaacccatggaagaaacaaacttgaggcttgagaattcctcctgtttcctcactgagaatgtcgcgatgattaaactctttctctgctgcaagtgccattgtcagtgtatgggtctgttgctgcccagagggcgtataagcctggcagtcctgcaacagcactggcaccctggaatgctcagccattggctgggatgggtgcagcacaagccagcactcacaggcaaggtgtaatggatccaaaagggtggcagctggggccgtcagctgactatgctccccactgtaagttcttctgaagacaatctgaataacaagtttctctggctgtccagaggccatttaaactcctgtgacataataaaaaataaatatttagccacggtccctggttcctgggacagagctccccaaacccttgggattcccagagtgctaagtgtcttttttatgctaatgtctgttggtgaggtccctagacagctagcttaagagactggtagctagaaaaaccagctatgcgattggggggttaaaactttcaacccctggccgggagcagtggctcacgcctgtaatcccagtactttgagaggtcgaggtgggtggatcacaaggtcaggagttcgagaccagcctggccaatatggtgaaacctcgtttctactaaaaatacaaaaaaattagccaggcatggtggcacatgcctgtaatcccagctacttgggaggctgaggcaggagaattgcttgaatctgggaggcagaggtggcagtgaactgagatcacgccactgcactacagcctgggtgacacagcaagattccatctcaaaaaaaaaaaaaaaaaaaaaaaaaaacaacttgcagccccatctcagtttctggggagaggcgggggctggagatttaatcaccaatggccactgatttaatcaattatgcctaggtaataaagcctcaataaaagttcttgaactataaggtttgggggtcttccaggttggcgaacacatcaaagtatctacctagagtatggaaactcttcacaccccaccacctaccccttcatctcccaaaagatgccttacgcatctcttccacttgactgagttgtatcctttatgataaacctgtaatcataaatatagtaatttctgcgagttttgtgagtcactctaatgaattatcaaaactggggaaggggagatgcatgggaacccccaactttgtagtctggtgggtagacatacaggtagcctggagactccatttgcagctagtgtctgaagtctgaagtggggggcagttttgtgggactgagcccttaatttgtggggtccacactaactctgagtagttagtgttagaattgaactgtgggacacctagttggggtcacagttagttggtgttagaatgacatatttgatgtcaggaaaaaaaaaaccacacaactcctaatgatcctgtagaccaaagctcaaacgtcacctctaaggaaagatcttcctgctcccaagaccagctgagaccccagctttccttgcaagcttgtccagcccagggcccacaaggtgcatgtagcccaggtggctcaggatggctttgaatgtggcccaacacaaattcataaactttcttaaaacattgaggtttttttgcgattttttttttaagctcatccactatgattagtgttagtgtattttgtgtggggccaagacgattcttcttcccatgtggccccaggaagccaaaagattggatacccctgctttaaagtatacatatttgttcacatattaataaatgtctgtcccatcaattagacagtaagcttcataagggcttattttgtgttgaatagttatttgttcctagtttttaattagttcttttaagctagagatcctctcattccatggtggttatgaggattgaaagagttagtatacatagtgtgcatttacatactagctactacgtaagtgctattattattattgctcatgttgaagtctctacaatactaatacgaagtaggccacaaaaatgttaagattaacataatttacatacaaattcagctcaagttaactgtaaaataaaattccatattataggttcattttcaaaatatatttttattttcttcaaacagcatcaagctaaaggaccaggtatggttagacaagtacatgaatgtgaattcaaccctatattaccagcacaggcaagaccccatttcccagaattggataaaactaggtaaatgcatgtctttgtcttatatttatctagaggtgatataaataatgtaaaatatttacaaacaagcagaatattaaaaggaaggataaaggtttactttggattagaagtttgtgtaagcttttttctcttttaatttgtgtagacagctttgatatttaaggacaagacaaaaatcaccaagtaaaaataattgggaaagccagtatgaattagtaaatacttataataacttaaatccaaattccatcaagaactcaatcttggccaggcgcggtggctcacgcctgtaatcccagcactttgggaggccgaggcaggcagatcacaaggtcaggagtttgagaccggcctggccaatgtggcgaaaccccgtctctactaaaaatacgaaaattagccaggcatggtggcatgtgcctgtggtaccagctgctcaggaggctgaggcagaggagtcgcttgaacacgggaggcagaggttgtggtgagctgagattgcgctgttgcactccagcctgagcgacagagcgagactctgtctcaaaaaaaaaaaaaaagaactcaatcttgtctgagagtctatcagaggtactcagaataatttaatatattgatagccacagatttttactagtatactttctttctatgcaaataggtggtttatttatttatttatttatttatttgagacagggtctcactctgttgcccaggctggagtacagtggtacaatcacagctcactgtagtcttggagctcctgagctcaagctatcctcctgcctcagcctcttgagtagctgggacagaggtatgtgccaccgtgcccagataatttaaatttttttttttttttttttttttttggagagacaagggactccctatgttactcctggactaaagcaatcctcccacattggctttccaaagtgctgaggttacaggcacaagcccctgcgcccgaccacaagtaggtgttttaaaccagtgtttttttttaacaaggcacaaacattcgacttaagggtgacagcatagtactttaccaggaataaagttatgttttacacatatacacgtggaaaaattaaaaccctatgaagttggtattgtcttatattaagtaatgaggaaactgaggcataaagtagctaaggattttgttcaaagagcaagtgatggcataatcagaacttgaacccaggtctacccagcatcagagcccatattcctaatccccacactggggctgcaggaggaaattaatggaaggattcccacaaaacaagacaaatcttttaccatataaataaattcacattatgagtggacaaatgaaactgtactattaaagcactttatcctcttttttcttttttttttttttttgctttttgttttgttttgttttgtttttgagacagagtctcactctgtcgcccaggctggagtgtagtggcgcgatctcggctcactgcaagctctgcctcccgggttcacgccattctcctgcctcagcctcccaagtagctgggactacaggcgcctgccaccatgcccagctaattttttgtatttttagtagagacggggtttcactgtgttagccaggatggtctccatctcctgacctcgtgatccgccctcctcggcctcccaaagtgctgggattacaggcgtgagacaccatgcccggcctcttcatttttttaaatcagaaagtgtttctaatttttatccccaaaataaataaagccttctttattttggggcagcgggtaggcagctaattctactgagatatttgccattcattttccttggttttccaacttcattaaaggaaacaagtgagaaagtgaatctaagtaactaatggagatgcaacaaaaattcaaagtcatcccaacaggatctcagacatcaaacccctaaaagggaatatataattctgtacttactgcaactggttcacatgaggaaaaaaaaaaaaaaaaaggaagactctgtgagagataactaaacacttcctggtatttttttaatggttcatttgaaaatcttttcaggaatcgcaaaatagtgtacagtgagctcttcagggtattaaggcctggataacccatcagaaagctgcctctttctgagcaatttgatctggcaagattccagggtaattacaaccaaataagaaaacagatgcaacagttaatacttatgcgatgatatgagcttagaaataaatggttgtatctaaataaatgctttttaacagaaaaaagtcatgcaaatcatgttcatcgttaactattcatggacacgagaccatatgtctgtgacctttgttactgttaagtactatagcttgtagatacgtgggttacttgaaagtaattggctgcttctactgtggcgagacactaattattctgaggaggaaagaaatgcaacaatctctaattgatttccagattatccaccccatctaagggtaaacctaagctaaataataatattaaaggcctggtactttccaaaagctaagggatgaaagaaaatctactgtttatcggccataaggttatatactgtttcttagcaaccagggtttgtctttcagagactagaagtcgatgaaaaaggagagactaaaaataaaaccatctggacagttccaattcacagaggcagcacttcaaaggcagtgatgttgtgataaaccatactgttgagttaaagttcattccattggctagaaagagaggctcatgacacttgcttaataaatgtttcccggatactcactgcagtccctgaaccaaagaccaggaataaaagctacctatctgttcctgcatagagcacatatcaacatcagggatgagaggtactatggtcactcacctcctcactctctcagctccactcctctggttgtaagaggctagtttatctgcgagtcttgctgggacgtaggcttgctcctacctagaggcagaatttgaaccttctaccccatatcacatttcttgttgacccttacctgttagtgtctgatacagtaattccgtttaggacaccaagttttgtttttctgttttgttttgttttgagacagtctcgctctgttgcccaggctggagtgcaatggcgcaatttccgctcactgcaacctccgcctcccgggttcaagcgattctcctacctcagcctcccaggtagctgggactacaggcacgtgccatcacacccagcttattttttatttttagtaaagactgggtttcaccatgttggccaggctggtttcgaactcctgacctcaggtgatctgcctgccttggcctcccaaagtgctgggataacaggcttgagccaacgcgcctggcccagcaccaaatttttaaaaacagtaagggaaaagttatttccatactggttggagtatgagttctggagatacctggaaaatgacatcttactggatgcctaggcagttccgacacacccatatctttcaatcctgtagccagtcacaaaaatcaggaaagtagtattcctggaaggaaccgggctggttatttaccaaaggactgcaaactagccgactcaatttataaggtgcggcatggatactttcatttaagcaaatgagctttcattcagtcaaaatccctgttgttgggcccctgtggttttaaactccaaggaccaaggtgcttgtgagtgagtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggttttaacagctgagtttcggtttctcagaatcagcagcagactgcgcccgccccagagaacttccccacgtattctccactgaggccccgtccgaccttatcgcgggttaacagcccaggatgttgacttgagctggcttggtcggctacaggtgagacggtttaaagtctcacaatcaccttagaggttaatcagaataactgggatcagccacggacacctggtgagcgattagcccgcagagtgactacaatcctgaaagatacttgagaaactgtttaacaggcaactctaatttgaggttaccgctggatatttgagactgtaaaaaatatattaaccttaaaataccagagattaggtcaataactaaaatcatctcaacaaaatgtcgccttttatcagtaatgactgctgtgtggctgttaccaatgcacatactttcaagttagaggaaatggaaactgaaatcaaaagaaaacaaaaacctacaaagccggagaagtaagctaaggtagacatgattctccaggcagccttgctaagtaattgactagacattcgagaactattaaaaatacctgctctgtgcagaacagtgtgcaacggtgatgtggggacattttaaaatatggatgtgtaaggctcagttcctgtaggttcaggggtgagctctggcattcatatttttgaaaagctcccagatgattctgatgtgtgccagggttggtcaccagggtcacaatgccgtctacacaaagatgagtgaaggctcttccctcatgctacctgcattctaggagtatcctagtagacaggtaaacaaatgggaatgccactttgggataaatgaaatgacaggcagctgtggaggcacagagaaactggggattagccctctgagtaattcaggaacagggacatttgagaatgagccaccaaagacataggaattcaccaagaagaaggagatgctatggcagaggcttgtcacttaaaatgacatggtgtgtacttaattccaggggttgtcatgtggctggagcaccccagtcctaggtcagcaagacagttaggagctggactgtcttccttatattattggtgcttagaacaaaaagacacatacaggtttgatagctaatgaaagaatgaaattgaagggtgggccagggtgggacaggagaggagaaaataatgacaaggaacatggtaggaaagtcagtcaggatttctatgccatcctaagacattagggttttgtagagtaggccagagtttcacaaatttcagtaagcatcagaaccacttggaggagggtgcgttaaaacagatttatggccaggcacggtggctcactcctgtaattccagtacttttggaggccgaggcaggaggattacctggagatcaggagttgaagaccagcctagccaacgtggcgaaaccccacctccacctgggcgacagagagagactccatctcaaaaatatatatatatagtttctgattcaggtctgggatggggcccaaggatttgcatttctaacaaatttccaggtgataccaatgatgccagtctcaggatcaccctttgggaaccactgttgtaggcaatgtggaaggcacaggaagtttttcaatagggcagttactcaataatatctgttttacaaagttagcttctaacaatgtgaaaacggagattgaaagatgaagagactgaaatcgggaagataaattcagagcctagttacgtctaggtaagaaatacagatctgagctaaggcaacccagaaagtggggagcaaaatcaagacatttcacatgggccaggctcagttgctcatgcctgtaatcccagcacttttggaggctgaggcaggaggatcacctgaggccaggagtttaaggccagcctgggcagcatggtaagacctcatctctacaaaacaaataaataaaacataaaagacatttcacatgagagattagcatagataaaaactagatgaaagagagaattgagtactggaaggcagcagagagaaggggagatggcttttatagtgctttgagaccagctttgccacatactggccacacaaccaaggccaaatctcttaattcctcagagatccagtttcctcctctgcctcatgtgggtattgtgaggaatagagatcatccacatcagtggttctcaaatggagttgatttttcctctagcagacatctggcaatgcctggacatatttttgattgtgaagcctcaaagtgggtaggtgctgctagcatctagtgtgtaaaggccggggatgctcctaaacatcctacaatgcacagaataggcccacatgacaaagagttgtcctgccccacgtgtcaacagtgttgaagttgaaaaatcctgatcttcacagtatgcctaccttatagccccagtaatttaatggttgctgtctttatggtgacttttagctttgtgactggatacgaggtagaaccattaacctagaggagggacaagctttgagggaagttctaaaagtctgtttaggtgctgttgggtgtaaggtaccagcggggtgagaaacgcagacctagagatcaacaaaaaagaggaacagcagggcctttctggaggccatcttccacattgttctttactaggaaaatacccctggaactcttgtttcaaaggagaaaattattttggtggttggatgaaatttaaagtttgaggaagggaaaacccacactgggggaaaactgattctcctaaaggagctagtaatagggatgttggcctcaagaatatacttagttaaccatatttgtttcacaacacaaccacatgtcacaccaaagtttcaaacctgagatttctcactccattcacttcttgttttacctgagatttctcactccattcacttcttgttttgccacattctcaaagtgttttaaaaaatgtgaatgtgaggctggatgcggtggctcacacctgtaatcccagcactttgggaggccgaggcaggcggatcacgaggtcaggagatcgagaccatcctggctaatacggtgaaaccctgtctctactaaaaatacaaaaaattagccgggcgtggtggtgggcgcctgtagttccagctattccgaaggctgaggcaggagaatggcgtgaacccgggaggcggagcttgcagtgagccgaaatcatgccactgcactccggcctgggtgacagagcgagactccgtctcaacaacaacaacaaaaaaaagtgaatgtgatttattatggcaacagacatctacaggctccttttggatgcccgagaatgggctacttgtgtatcatccattctttcaccgtaggtgtgtgcatttgggcgaaaataagggctggccttttactggagttgttcttgggtgcgtttttctatagtagtggctggtggagagaagcagaggtgagtggggagggtcctgggcccctatccctatttagccaagtactttagccccttatctcttctactcactaggccactgcctaattttgtttgaggcaagaattcaatggcttttaaaagtttgaaaaaccaccatactagacaattacctaggaatatgttttaagagacatgagaaagaagtgaaatctagtgggattgttaccttacctgaaatttggccaattagagattcatttaggaaatgtttttcttttcaaatgaaactgcctctgggaaataatcatgtattcgttccttttggtaaatgagtttaatctgagcaaaagacattttggctggggaagaggagaactgagtgaaaagaaaaaggattccaaaagttgtgtaaagaaaaacataaaatgaggcattgttggggaatggaaattcagaaatacaatgagcaattttagccagccctatgagctttaagagagaagattaaatcaaaaagaaactttaccaatttattttactgcaaacatgtctaagtgtgtcttctttcaagaaaataaatgggaatatatgtctgatttttaaattaattgccttagattactcctgcattaatatgtacaaatatagagagagatacataaactctaagacttttcttgtcataaaatgtgtaaatgaaaaaaatcttagtttttgaaaattctaaaaagtcacatttccttaaatttgattcttcagtggaaagttagattaatctaagagatttaggacagcagttatctaaaggttttttttttctcttctaacaaaggagttatgtaaaactctgaatatttggtatctcctcatttttagtgtgtgtgtgtatgtatgtgtttgagcatacctgtattgtgacaactccatgtgaaattcttcaaatcctaccatagaattgtgaaatggtacaattatgagtcaccataagttcgtacaggaaatattttttgaatgacaagcatgtatcattctttgcatcataccatggagctacagtggtaagcagacagaatcttgttattccaccttcatatttaagagcatctaaccactttattctaaacaaggagacagaggcttagagaagccaaatgactcaccagcactgcgcacaaactagtggcatagctggaacataaatttaagttgtccgagccccaagtgtagcttttcatattttggaagatgattgtgacaaaatgtctcttttgacaaaattcagaattcggcatgttttttacttattataattatcccaatgagcagctgtgcattactttctaaaatcaaaatgactatgccaaagtttctgaacctgtcagaatcaacattaataaaaaccttaacactccaatatttacccctataattacacgatcaaatgatctctacaatgatgctgttttatacaacttgtcaacatttcatgaattgcaaatatgctacatttgggctaaaaggccttttctttaaccgtgttaaaatagtgagccttatagtgtagtgcaaagaattctacttaagaatggaaagatacactatttttcggatgacaatgtgtactgtcacttggggaaatgaggaatgtagaaatgtgctttaaatgatatttcctaccctcagataggtggctgaatttccttgtttgtaaattcaaatctgaggagtaggtaacagctgccatatctgggttctaacactgtgtagtagctgtcacaagatctctgctagctgcaggaatggaaggaatttcccttaactttggggaaacttctgtagactcagtggcgttgacagggagattaccctgaagggtttctttagctgtgataaatgaatcaaacagaaactctctaaagtcctcttcattttttgtgtgtacttttttttttttttctcatacaaagtctcactctgttggccaggccagaatgcaatggcatgatctcaactcactgccacgtctgcctcccaggtttaagtgattctccagcctcaacctcctgagtagctgggattacaggtgtgcaccaccacacccagctaatttttgtctttttagtagagacggggtttcaccatgttgctcagtcaggctggtctcaaactcctgacctcaagtgatccgcctgcctcagcctcccaaagtgctgggattacaggcatgagccatcgcagccggccttaaagtaccagttatttttactcaatatctgttccttttccaatgatgccccttcttagggaactcctaactgttctgatgttttaactccaagccaacacttttgtgagcttcatggtccttcgtaaatatcaccaggtatgtaagaaaacgtggtagaggggaaagagtaatggccacaaaggcagaagacctgaacttgagacctggcaaagccatttaaagagttttgtgacctcaggcaatcattgaaactctctgaactttagttgctttatttgtaagatggaaatattaatcataataacccacctgtcctatctaccttttagaagcttgtgagggccataaattgcaccttgatgcaatataagttgatgttataatttttgagttgtcaatgttagagctttatatattttttctaataatacttaaatttgtcctcaaagaattcttaacttcagtttcagtggcttttggttttaaattgctaaagcattacagagctatatctttagtgggttttttttgtttttttttttttgttttttttgagacggagtctcactctgtcgcccaggctggagtgcagtggctcaatctcggcttactgcaagctctgcctcccaggttcatgtcattctcctgcctcagcctcccaagtagctgggattacaggcctgcaccactacatcctgctaattttgtatttttagtagagacagggtttctccatgctggtcaggctggtcttgaactcccaacctcaggtgatccgcccgccttggcctctcaaagtgctgggattacaggcatgagccactgcgcccggcgagtgtgttttatcttgaaatccctttcagaatagaaataaagtagcgtttatagttttacttaccaatatagaaatgcctggcacagaatacagtttccagtgaagctggaactctgttgtcataactaggagacactgggcattccatagacattttgtgacaatgttccatcctgatatcttctggtagctaacaagagtttcatttccggggataaggccttgggttctcctgtttgacttgacttagaaaaggagtcatattaggaatttccatgacctttcatgtttccaggactgggatatagggctgggattctccacaggcacatcacatgggttagagttccagacttttcagtatagtccacagtagcccaccaattattaggttggtgcaaaaataattgcagtttttatcattaaaaataatggcaaaaaccacatttacttttgcacctacctaaatatatggctcctctccttgaattaccagtaagacagtccttgaccaagagagagtgatgagaatggttaaagtaatgaggttacaggcagtctgaagaaagtgagtagtccctgtgttatccatcaatgcaggacacttctccaggtggccatggaccaatccagttctccctcatttcttgcgcatggttgtcaacagaatgtgctgggaatgttgtatcctgagatagaaagaaacggcctgaaataacccaggccttgtttctgtccctcctaaggaatgtaacatcttgagttagagagggactgcctgggacagcccaggctttgttcctctgtcccctagaagcaggatgtccttcaaagctttgcccagtgacatggcctcaagtgcataacccagggcagactgcttttcggggtccctcagctgtgctgcaagtggggcatgcacagtcaagactgcatcctccctgggcagctttcttgagccttggggacttgttcacaatggatctgagacatcttctgttccttaccatctgtaagtagtaaaccagtttcatgtaacttgtgtgtgagtgtgttctgtctcattaaactcagacaagtacctaaccagtatatcgtggacctaaatagtagcccaggatgcagtgggcataaatatatcgactcctgtttctgatgtatggcatagtgaactttgctattctccatgcagtggaggttctcactcagggtcagcgattagtgaacttgcttcacaatgaagagcttgctgttcaagcttctggttttgtcaaatagtcctgtgtttagattttggctctactacgtacaactgtgtgactttgggcaaattactgaacatctcagggcctcagtttcttctcctgtgaaataggaataatatttacatgacctactgaatagtgttgttgtatacattaggtaagtatgaaatgcttcatatcatgtatccaacatagtatattcaataaatgttgtgatcattattatttaagctctgaaaaaacaaagtgagcagggcaaaatacttgaacaagcactttacacgcacacacacaaatatccaaatggctaacaaatatataaaaaggaacttcatttgtcacagaggaaatgcaaactataaccataatgagatatctctatacactcaacaaaatggttaaaatgaaagagaaagactgttttgggcaaagaggtgaaacaactaaaacaactctgctagtggacttgtaaatcaatacaacctttttagaaaacagtttagcagaatcatctaaggctgaacatttttatatccaagcaattccattcccagatgtccaacacaactgtgtacatgtattcaccaaaagtcttatatgaaaatgttcatatcagcattattcattgaagtgtaaaactagaaactactcaaatgcctatcaatcatagaggaataaattgcagtatattcctataatataatactacatatgaggagttatatgtttgttattctgtaagtactagttggccattatcttacttcctcaggccgtccccatgtgtcgttggacttccgtctaactcatctcacttacataacttacattagttaaactttaggctcagctgcagttgtagagaatgaaaataactacagtttaaatacatggaagtttgctcttagatgccagtccgggcatatgcaggccaggggctaggatgaggacttaatggagtcaaggatctagacttccccatttgctccactctgccttctctaccgtgttgctcttacttgcatccaacacatacacaatgtagccagtgagaagggggaaaaggatactggagggcaagttcattccctttaagggtacaacttaaagattgcatacaatgcttttatttacgtttcactggccaaaatttagttgcatggccaaacccagtcacaagagaaactaagaaatgtggtcttaactagatgtaggcatactgtagtagctagcctccaaagtggcctccaatggctcttgccttcaggcatttatatccttatgctgtttgtttcctccaacattgaacaggactatctggtgtaaccttcagcctccattaagttgactacaattctagttgacatcttgactgcaacctgaggcagaaacatgcggctaagctgctcctgaatttctgactcttagaaattatttgagaaaataactatttaatgttgttttaagccactatatgtcaggataatttgttataagcaatagataactaaaacaagaattgaggagaggaaattaaagtgaaaagagaacaggggtgggtgtggtgactcacacatgtaatcccagcactttgggagaccaaggtgggtggatcatctgagggcaggagtttgagaccagcctgggcaatatgctgagatctcttccctacaaaaaataccaaaatcagccagatgtggtggcatgtcctggtggtctcagcttgggacttgggaggctgaggcaggaggattgcttgagctcaggaggtcgaggcttcagtgagcagagatcatggcactgcactccagcctgggtgagagagcaagatcccatctcaaaataagaaaagagaatgggacgtggtgtatgaaattttagatagagtggccaggggaaatattaatgtggcctctgagtaggggtgtaaagaatgtgtgagcacaggaagagtattttgggtaaaatcatgtttatagtcaaagtgtttatcaaccagtatgccacgggcactgacaaaacagaataggtgcccaaaaaataaacactgagacagatcataaacattcatcagggcctcaggtggagccccagctgcatatcagctgtgagcagagggaaaagaagtcaaagaccctggggtgggagagtggctgtgtttgataaaccacaaaaaggccaatgtgagcagagggagagagcaggaggaaatgaggacagaaatataatataacataacatgtgggccatacagtatagtgtcatttaagtcatagtaaagcctttggcatttattctgcatgaaacgggaaatgtttgaaagattttgtggaaaggaacaacatggtgttatatgttttaacgtgatcactcgggctggtatactgaaaacagactgaagcaaaatgttatagattgaaggtttgtgtcctccctaaattcatgtgttgaaccctaacccccattgcgatggtatatagaggtagggcccttgtgaggtaattaggtttagatgaggtcatgagggtggggccctcatgataagattagtggtcttataagaacaggaagagagacagatctctctctttccatgtgaacagaggaaaggctgtataaggatagtgagaaggaggccttctgcaaccccaggggagagtcctcaccagacattgaccctgctaacaccttgatgttggacttaaagtttctagatatgtcagaaaataatttttagttgtttaagccactcaatctatggtgttttgttatgtcagcccaagttgactatgacaaaaggcaagggtggaagcagggagactggttgggaggctgttgcaataattcagatgaaaaatgatggtggcttgggccagcatggtgcagcagaggtggtgagaagtggtgagattctggatatatttataaagtacaatgaacaagattttaaaagtaagatgaacaagaacagattggatgtcaggtgtagagaaagagtcaaggatgatatcaaggtttggaatttcaatcgctggcaggatggagttttcatcagctaagttggggaaggctgtgagaggcatttctgatagctgtggtgagccagggtatagtcatgagttcatgtttggacttgttgttttgaaagcctgctaaatatccaagtggagtaagttattgaagtgcaagtgtggaattcagggaaaatgcccggattgaagataagagtttggaactcattgtcacatagagtatatccaaagccaagtgattaaatgagattacacagtagtgagtttagatcaaaaagagtttgggtggacttgtccacagctgtaaattgtaggagcaactgtaacactatcaaacgagaactagaattctctccctgctcactccactttcagaagtttagttaataagagtgcatggtttccaggttagtgagctgggccagtgttccagtggtatagggtcaacactaacagtgtaagaacagacagacatatctaaacctctaaatctgaagtccaatcaagaatattgtcatggacaagggggaaatgctgttgactagcagctggaaaatcagttatttgtcttccagatcagtggttctcaatgttggctatactttggaatcaactggcaggctttaagcatcactgaggattgggtcccaccccaggattccgatttaattggtctggggtgcagcctagactctgggagtttaaaatgttcccaagggattctgaggtacagccaaggttgaaaaccaccacggtagctaaagaacgctacagttaataagtcatcattatcagcacctttacaaccagctcctagtttgctttttgttcagaaagatgttagaagtgactaaactatgacagcatgactgctcaggaggctaaaaatagacaaaataactgggcacagtggctcacacctgtaatcccagcattttgggaggccgaggagggtggatcacctgaggtcaggagttcgagaccagcctgcccaacatggcaaaaccccgtctctactaaaaatacagaaatttgcctggtgtggtggagggcacctgtaatcccagctacttgggaggctgaggcaggagaatcgcttgaacctgggaggcagaggctgcagtgagccgagatcacaccactgcactccagcctgggcgacaagagtgaaactccgtctccaaaaaaaaaaaagtatagggagaagcattaaacatatattttaagttgttgctaagcaggtatttctcagaacattaggccaagaccccaaggatgtgtggaaacagaataacaatttgggcttttttgtttggtttgtaccacagtaggtggtgtgcagtacagcagaagaatcatctactggtttgtaagggaaggatcacaaagcatggacacagagtgtatccaaacataggcaatgtgagtgaatttagcacttttcagaagaacgtagaataggtaagcatatacaaattctttatttttatttttagtttttcttttgagacagagtttcactcttgtcacccaggctggagtacaatggcgcgatcctggttcacctcaacctctgcctcccgggttcaaggaattctcctgactcagcctcccgagtagctgggattacaggcacctgccgccacgcccagctaatttctgtatttttagtagagctggggtttcaccatgttggccaggctggtcttgaacttctgacgtcaggtgatccacccacctcggccttccaaagtgctaggattagaggtgtgagccaccatgcccagccacaaattgtttattgatataagacatttttaactgtttgaatagtgctttcagagttccttcaaacatatttctatgtttgtttgccagagtatagctccatctgaaccccactcagttgaccccaaaaaggtcacgctgttcttgtggctacagtacagggacatcatgttgatgagacaggtaggtttcgtggcacagaattgtgaaagataaaagtattttgaagagcaaacctatatcaccctaagtttcttttgctttcaataacttaacatgactcaatgtagagaggacaagcaaaatgctagaaaagtggtacagtttgtactatgtcagcattagatttggtgtttaatttaggttaagacaatccagcagactttgtcccaaaacctcgcatattcacacagaatctggccataaaaacaaagttgagacccaaatgaaaacaatgttttctatttcttagttgtttgatagcaatgtgttttctgaggcaaaaggactgggatcatcaggctgttcttcctttttagggtgtatataatccaagaaaaacgtgctgctgggttatagaatgctaaggttgagttttaaactcactgggaaaataaatgtagcaatcaaaagtatcctgttgtaaatagtaataggtggattagctcttgggtactatcaacaacctgtgcttcaaaccaaatgtttaattctggctagaatcctaaactgtgttctaaggagatgactgacactggtattttaggaatgttaaacaagaatgttctctgtattgtcttttcttcttaaaagctacatgaccttgagcaaattactcaactcttcttaaattcattttccttttctgtaaagcctctgctatttgcttttacatgatctcagggacaaatgtgattattccacatgaaaaattataaagtgctttttatagttagtatctaacaagttaacaatggcatgctggataatctgcacttgcagatagtattgtagcatgcattagtgagatggtaccatttttagagataatgtgaatgttcccaagagagtttaaagatcaaaaagaaattttacatttattacattatttatcctgatataacctgtgaagaatgttagtttttcagtttttaaagatgacacaagcagctcagaattattgtgcaataattaatatgcacacacatatttacatattgtacagtaattaatatgcgcacacatatttacgtacgtatttattgggctactgctatgtgtcagccatttttaagcattttcacctatgttatgttagttccaaaagcaggcttcaaatctaactcattaaactctctaatgttctctttactagctaactctctattttatcatattgggcattttaaaggagacactatccagcaaaaaagtgagaattaaaatatatagtaacatcatacacaaggctcccataggtatatggatgaaagatacatgcagagaaaaatgacaaaatattctttttttttttgagacggagtcttgctctgtcgcccaggctggggtgctgtggagccatctcagctcactgcaacctccacctccaaggttcaagtgattctcccgtctcagcctcctgagtagctgggattacaggtgtgtgccaccatgcccggctaatttttgtatttttagtagagacagggtttcaccatgttggtcaggctggtctcgaattcctgacctcgtgatccacccacctcggcctcccaaaatgctaggattacaggcgtgagccaccgtgcccggccaaaatattctttatacatacacagtgctgaggctccgaagcccatactccaaaatatggcgctttaacatgctgaactgaagaagcctcaaggtctctctgaccttccccactaccgcatactgtctctcctaaagcacagaatgaagttgaagttcctttatctgcctaagatccagaccatcccaaaagaacaattgtttctttttttcccctccctgtaagaccaagatacaaccaaacctgaataaaccctttcacaaaacgatgtaatctctgttccctgatccattccttctccctggtaatcccctcaacagaattcctctttttccccctcccataacttgttttgccaacacggtgtatgaacttctgaatccctgttgggggatgagtaatcactttgtggttctccctatgtacagcttaaaaaattcctgtgccttttcttgaattactctgccttttgtgagttgaatttttagtgaacctttagagggcaaaggggaagtttccctacaataggaatacattattataaatctctttcagatgactttttagaattttcaagttcagaaaattgcatacctaagaagctgatgttaatgcaagcaaacaaaggattgatattgtgaccaaatgcaggtttagccactggctgcttgcaaaatccaacaacaaggacgaagtgcagtacaaacaaggtgacttcattgtttgaagctagcagtggggaagtggttcaggctcctgccttaagaaaaccactttaaaattctcaggcaaaatgctagggtttaagaagtggggaggtggtgaggcagtacaggtctacatgacctgttccagtgacttgtgttattgccccaactggtgaatgggctgtcaccatctcaggcttgtccaggttgtcagttacctgcagccttgaggtaatctcctgtgggggagaagtccacaggcacctgattgtctcaagacccggtctctggaacttcttcttcttttttttttttttaaatttgagatggagtctcgctccattgcccaggctggagtgcaatggagcgatctcggctcactacaacctccgcctcccgggttcaatcgattctcctgccttagcctcctgagtagctggaattataggcgtgtgccaccatgcccagctaatttttgtgtttttagtagagacagggtttcactgtgttggccaggatggtcttgatctcctgacctcgtgaagcgatccgcctgcctcaacctcccaaagtgctgggattacagacgtgagccaccacgcctggccggtctctggaacttctaagcatacgtaactagataagctagcaaggcaagcttatggtggaaagaaggagagtaattattattttatcactaaaaagttaatacaaagggcagcagaaggaaaagggggaaaaatccttaaagccagggttctcagttatagtattagtttcttagggctgccatagccaagtactacaaactgggtggcttagaacaacagaaatttattctctcacagttctggaggctagaagttcaaaatcaaggtgtttgcagggttggttccttccttccaggaggatatgagggagaatctgttccatgcttgtctttccgctgcggatgtttgtcagaaatattttggcattccttggcttgcagctgcctcacagccatctctgcctctaccatcatgtggctttattccccatgtatctgtgtatcttcaaatctccctctcctttcaaggacacaagttcaccctaatccagtatgaccccatcttaacttgattacatctgcacaggccccatttccaaatgacatcacattcacaggtaccaggggtaggttttcacaggttttcaacatttcttttgggaaggcacaattcaacacacagagggtttttaaaacttttttttgctgaaacatttgagtgtaatttgtaatcacattgccccattactcctaaatacttcactgtgtattttcctttttttttttttttttttttttttggacagaatctcactgagttgtgcaggctggaatgcagtggcatgatctcggctcactgcaacccccaccccatgggctcaagcaattcttttgcctcagcctcccgctcagctaattttttgtatttttagtagagaaaatacaaaaggaatctcactatgttgcccaggcttgtctcaaactcctggactcaagggatccgcctgcctcagcctcccaaagtgctgggattacaggcgcaaaccatcacacctggcctacttcagtgtgtattttctaaaaatcaggacactctcctacataaccacagtatacccataagaatcaagaaattaacatggatgcctattaccatcaaagacacagattccattcaaattttgccaatcgttccagtaaattattcataacaaaacaaaccaaaagcaaatttcttccatgttgcattctttcttcatgatctaggatccaatctaagaccatttagttgtcctatctcttctctttcaagctggaactgttctcaagtttttccttgtcttgaataattttgatattttttgaagagtacagactcataactttgcaatgtcctttaatatgggtttgtctgatgtttccttaagattccaataaggctctgtatttggacaggactaccacagaagatgctgtgcttttctcagtgcatcatgttgggaaacatagtatgtcagtttgtcccattattggtagtgctgactattatcacttggttatgatggaacatgctgggtttctctacagtgtggttattgaataattaataaacagttgatatgcaattttcaaggagatactttgaggctatgcaaatatcctggtcctcatcaaacttttacccactggttttagcatccattgatgttttctgcctgaatcatttatgattgtgaaatagtaatttctgactccatcattccttctctacttattagcctgcattcagctgtaaggaagagctttcccttttccctttggtattcatttatacaaataagcactggtggatatttattttatgcaataggttataattcattactatcattactttgattgtcacatttgaacagtgaaagccgtttcatgctggcccctgtatccttttttttttttttttttttttaattttttaaatatagagatggggtctcgccattttgcccaggctggtctcaaactcctgggctcagacaaatcttcccacccagtctcccaaagtgctaagattacaggcgtaagccaccgtgcccagccccctgcatccttttgacacatccttatcattctttgagtgcttcttttgctttctggtataagatgttccagatttctcttgtacttttcctgcctcagccatgaaaatacccatttcaaaaaggagacatgtttccttttagtggggagtggtatttagaaaccaagatttgggtgcaaagtatactgctttttactagagtgtcattgcttctaggccctttcagaagacacatgtaggaaatatgtgtatgtatacatgtgtacatatgtctctatttctgtatctatccatatagatatctattaacccactgacaaagtatagatagtatggtagacagaattctaaaagcggatttcctgagattcttgtctcctggttattcaatcaaacattaaattaggtactgtagtgaagggatttttgcaggtgtgattacagtcccaaatcatttgaccataagatgagattattcaggtaaccctggtcaattcaggtgaatcttttaaaagcacagagtttccgccagctgggagcagaagggaagtcagttagatttgcagcgtaagaaagtttgatgtcctgttgctggctagacgatgggattagagaaatgtgatgaggaatacaggtggtctcagagctgaagacaacaagataacagaaacctcagtcctacaaatgcagggaactaaattccgccaacaatggctttgaaggcagattctttcctagagaccccagacaaaggccagcctgactgataccttgatttgggccttgtgatgccctgtgcctagaacccagctgagccctcttggacttctgacctactgtgagctaataaatgtgtgttgttttaagctaccaagtttgtggtaatttgttacatcagcaatagaaaaccaatacagatagatattgatataaaactataaatttacaccaattctaatccaatgccactgagcttttctagttttccctttttcatatctgtacctccaaaaattaataacctgattcccactatcttcaagatatttacttatttgctcaatctcctcatatgtaaacaacctctttaccatgtggatcatctccttggccttggccccacagcacacagtggttgtactggttaagtgcccctcaatcccgatcctatcacatatagtaaatcttactgtttgagatggctcccaaccagaccttatcactcacagggcctatgccagctaagttgccccgggtctatggacccatggatgatttatatttatgtatattttactttatttagcatcatttcaggtatgtaccacttcctactctaacaacattatcacttccattaatatgaaaaggattttctaagtccccattgttctaagaattgtattagataggccgggcgcggtgcctcatgccggtaatcctagcactttgggaggccgaggcaggtggatcacctgaggtcaggagttcaagaccagcctggccaatattgcaaaaccccatctctactaaaaatacaaaaaattagctgggcatggtggaggtgcctgtaatcccagctactcagggaggctgaggcaggagaattgtttcaacccagggaggtggaggttgcagtgagccgagatcgcgccacttcactccagcctgagtgaaagagcgagattccatctcaacaacaacaaaaataataacaagtattggctggatattctgaagcaattcaacatgagcaatatgacggccactgtcaggccacctttttttttctttttttttttagagagggggtcttgttctgttgcccaggctagagtgcagtggcaggatcatagctcactatagcctggaccccctaggctcaagtgatcctcccaccttagcctcctgagtagctgggaccacaggtgtgtgccaccatgcctggctttaggttgttgttgttattttttacagatggggctcattatattacccaggctggtctcagactcctgggctaagcagtcctcccaaagtgctgggattacagatgagaggcaccatgcccagggaggccaccaattttttttttttttttttggtctgagatggagtcttgctctgtcgccaaggctggagtgcagtggcacgatctcagctcactgcaaccacagcctcccaggttcaagtgattctcctgcctcagccttccaagtagctgggattataggcacccacgaccacacctggctaatttgtgtattttcagtaaagacagggtttcaccatgttggtcaggctggtctcgaaatcctgatctcatgatccacccaacttggcctcccaaagtgctaggatgacaggcgtgagccactgagcctggccccattttttaatgtggttaagtatagaagaattaggatcctgaatggatagctgaacttttactttgcctgacacttttcttcaaaatctgatagactgtctcatctggtttttttttttgttttttcttttaacgccactcaatgatctctcatgtcattttgagatgtttttgtaaacaaacatactgtgatataaaaaacatatatttagtctttgtctcagtccattttctgctgctgtaacagaatgccacagagtaggtatatttatgaagaaaagtagtttatttggctccttgttctggaggctgggaagtccacgactatgcatggtgtcaatatctgatgaggaccttcttgcatcatagcatggtgaaagatgtcacatggtgaggaagcatgcacacaagagaaagaattggggctaaatgtatctatttatcaggagcccactcccatgataatggcattaatcctctcataatctaatcaccccttaaaggcctcattcccaataccattacattggcaattacatttcaacatgagatttggaggggacatgcaaatcatagcagtcttcatccacagttcctggcacagagctcctaaaatccttagaattcctgagtgataggagtgacaggagcatcttttattactcacaagaagctcctttcaaccataccatattataaacataacataaatcatatcaaacatatgacataaaccatatcaaacatataacataaactatatcataaacatactgagtttatgataataaggtgactcttagataatggaaactaattgtcagggaagccaaccatgtgtttagggagttggcacttatagccccaccccctaaccttcagggaggggagaagggctggaaattgagttcaatcaccaatggctaatgttttaatcaagcatgcatatgtaatagaacttcctattactattttgtaattaaaaaacccttacgtttattaaaatgtaaaccctaaacaacaggatttgaaaagtttctgggctggtgaacatgttgagatgatgagaggatggggtgcccggagagggcatagaagctctgtgcacccctcctcctgataccttgtcttgcgcatctctcccatgtggctgtttataatagttatatcctttataataaactagtagtaataaataaaatgtttcactgagttctgtgagccattacagaaaatccttgtacctgaggagagggtcatgggaacctctgatttatagccagtcagtcagaagtacaggtggaaacctgggactcgcaattggcatctgaagtgggggcagtgtcatgggacaaagcccgtaacctgtggggtctgcagtaattacagggtagttagtgtcagaactgaattgtaggacacacacttggtttccaggagggtgaagaattggttggtatgagaaaaaaccccacacatttggtataaaaagtgtcgtgtgggtagccagaaatggtttttccttttacagcccatgtgtttattaggaacatactttctacacatttcttctctttttaggacagagagagaagagggaagagctgaatttgaaaaaatgtaaaacataataaattttaattataataggtaatactcagaacttgttttgctgtctagtagaaaaagccctcctctctcaactataaatatggctgagagacaaggacaaaataattatatattcacctccatctttcaataaaggcagaaagagctttccatttcaaatttgttttgttttgtaccacatgtgggttaattagataaaaccatgtcatgtgccagattcaatcagcctgaaaataatcagaaaaccgagtttggcattgtttatgctgttttggctcagctagacaaaagcacaaaatgtaaattggctccagaaagcaacatatgtgtactggtgccagcttttctttcatgggattatctctagctggcacctgagcagcagaggctgctctgggtgaccattagacaaatctacatgatgtagatacccattttcctcgattagacagtggacaccatcatgacggggacttattttactgctttgacataggccaaaactagcttgccaactattggctgtcagtcaactgaaaatacaagttaaggttaaaaaatgaacccacatttttgtttggcatatccccttgtggcttcctttaagctcatttcttgatttttaattggttgtaagattaaaaataaaggctgggcatgatggctcattcctggaatcccagcacgttgggaggcagaggtgagagaatcacctgaagttgggagctcaaaaccagcctggccaacatggtgaaaccccatctctagtaaaaatacaaaaactagctgggcgtcatggtgaatgcctgtaatcccagctactcaggaggctgaggcaccagaattgcttgaacccgggaggcagaggttgcagtgagccaagatcgtgccactgaactccagcctgggcaccactgcactccagcctgagtgacacagtgagactctgtctcaaaaaaaaaaaaaaaaaaaaaaagattagaaatgaagccctgaaaccactcctcagctgtatttccttgttgtatgcagttcagtgaaatattattaaagagaagaaggcagcgcatttcactgtcttcctaccttaaggtggttttttagtgtttcaagggataaatattttagcaagtattcaagcaatcacagagtgagaaatagtcatttcaaagacctaatcatctgactgatgatgataagctctgcatgagttggttttctcttctctttttgctgtataaactattcgacattactacacagaaaaatagcattatatgttgttctttttatactttttttaaaagaatactttctagaatattctagaatgtgggatgggtggtgatcattgtctctagtatgaattaaactcttcttgcttaggtcaccagtgatcacctagttgcaaatcttatgggagcattttatccttacttgacttatctgtgagcccctggcatttctcactattttttttttttttttttttgagacggagtctcactctgtcacccaggctggagtgcagcggccaatttttgtatttttagtagagatggggtttcaccgtgttggtcaggctgatctcgaactcctgacctcatgagccacctgcctcagcctcccaaagtgctaggattacaggcgtgagccatcatgcccggctctatttcgttttttaaaaacttactttgtttccatgaccccactctctcctggcttcttctatctttttggctttttatttgtggtttctgtcacctcctcccctctccttccactgtccattccttgagtcttggtgtccttagagcgtaatcttcactttcttttcttactctgtatatttttcctagctcagtagttgccaatgaaagaaatctaagaatcaccttggatcctcccctttccttatctctcctatttgttcaatcccaaatcatcttgactatccctttatcatcgagttcactccttggatcagttagaatgctgtggttacaaacacagaaaacccaactaaaacttggcttaaaaataaggcaatgattttctcaacaagttaatatatttaaaaaggtggagaaagggaatttttaaaataaaataggactaatatgacataatgattgtcttcgtctagtttttgttgctataaaagaatactacagactggataatttgtaaagaagagagctttatttcttacagttctggaagttggggagttgaagggcatatggtgctggtgtctggtgagggcctttgggctgcatcatcccgttgtggaaaagtggaagggcaagtaagcacatgcaaaagacaaaagcaggaggggcggagcttgctttgtaacaactcactgtagcaacaactaaccctgtcccatgataatggcattaccccacttacgaggaaggagccctcattacctaaacacctcctattaggcctcaactcccaacactgttgcattcagtattaagtttcaacacgagttttggaggggacattcaaactacagcaaccatctaccgctatgtgtggactttgtttagatctgacgtaaacaaagcagctatttaaaagttttctgtaacaatgaaatttggatattagatgacacaaaaggtgatcactaatttttattagatgtcacaatggtgcagctatgtcagaagatgtccatatttgggaggaatgtatactgaaatgtccagagtgaaatttcttgatgcgttttaaatacttaatcagaaaaaggaaaataaatgaagaattgtgacagaatcttgacaattgttgaatctggttttgggagatatgagggttcattatactattctttctacttcttcaatgcttgcaattttaaatacaaaatttaaaaaattataataaaggaaatttttactctcataactaaaaagtttagaaacggggtagacatcaagtgaagattcatatagtcaacaatatcatcaaggactcagtttctttttaatttcctcatgactttcaatggtgtttgcttcatcctaaggccatctcttctcatggtatagggaccatatatcctggtttgctagacagtctcagttatatctattgtcctaacataattatttatagcactatctttctttcaaatgtgacctcgttttggatgataaattaaatgttaaccctagtttatggttgtcaaatgactgccaactacaattagtgcttcacacttctctgttcatgtccagctaaagagagaagctgctgtcccagaaataaccaacaaaccttttctataatcccaatgtcccagaagggcaaagtgtccatccatgaaacagacatcatggctagagtgatgggatgcatcagttggcttaggtcaatcaggggccaccctgagaataggggacaaagtcaataggtgggtccatggtaggtggggccaagagggattaaatgtggagaagaatccagttaaagccactatactcctccttgccatatcttctgccagtgccctagtttagggctcagcctctcttagactattgcaataactttttagctgatctccctccttttgctttggcctatcactacgttgctgccacaatgatcttcttagtatgtaaatctgatcatgtcactgccagattcaacattttttgatgtcctgcttttacctatgagataaagtctaaatgcctctgcttattatataaagctgttcaatacttggcctttgtctagttatctgtccaccctcatccatcttcagtcgtttctttatactttaaacttcagcaaaactgaatgactttagtattgtttacatacaaggctttctcacacattgtttccccaagtctgcctcatatttatcagttcagcaaatttgttttcatccccccattgtcatcttgatgctggcttctccgactccttccttgaacatttcaggcccgtttttggtgcccactgcactttgtcatacagtaaagccagcctcttttctgaccagaccaggctagtggttggtgggttaattgaaaaaccaattaaaatctgagatcacaacaatatacatattttaaccttttttttttgagatggagtttcactctcatcacccaggctggtgtgcaatggcgcgatctcagccccctgcaacctctgcctcccaggttcaagcaattctcctgactcagcttcctgagagcctgggattacaggcacctaccaccacgcccgcaaatttttttttttttttttttttttttttttttttatgagagggagtcttgctctgtcgcccaggctggagtgcagtggtgcgatctcggctcactgcaacctccacctcccgggttcaagcaattctctacctcagcctcccgagtatctgggattataggcgcccaccaccacatccggctaattttttgtatttttagtagagacggggtttcaccgtcttggccaggctggtcttgaactcctgacctcatgatccacctgtcttggcctcccaaagtgctggaattacaggtgtgagccaccgtgcccggccagtaatttttgtatttttagtagagatggggtttcgtcatgttggccaggctggtctcaaacccctgacctcagatgatccgccttcctcagcctcccaaagtgctgagattacaggcgtgagccaccgtgcctggacactttaaccatttttttttttacaacatatataaattactgtttctcaaccttttttttcttcattatctccacccaaaagttttttttttgacttttcttctaatacactccctctacccacatgaaattttagtgtcacaacagacacactgtatgtgtactctatgtacatccgcagggctgcagggccaaggccttttatttggatgtgggtcctctggttcagttctgccttggatttcttccacactggtaatccatcctctatgattcctaatttgagtttgtttaaaatgaaggtggagcaagacattttaaaagcaaacagtacagaatcatagtcagtgtttgtgattctcttcccatgctcaccattcaacagctttttaaaaataacctgttttatcaaatatttccaaggcatttaatttcattttcatgaaaacaactatttcctctcccacaattatattttatcactatgcgatgttagtcagattttgtaatttcaaagacaagacaattggttggggatcaacacaactgctgggggaaggaggcagagctagtgagagaaaatacacaaggaaataaatcggtgaaagaggtaacataaagaaaatagtaactaacaattttgtagaagttactaagtatcaagcactgttctaggagcttttcaaaagtgaactcatttaatccctacaagagaggtgctattattatcacctactttactaatgaggaaactgaggcacagagaggtcaattgtctttgttaaaattcctttcaaacaataaatttttagaacattttccactgagatgtttcgaagacatactaccaatgcaatctgcctttcttttacaaagtctattgaacataatgtaatctgtctttgaagtggcgtaactaataaaagtaggccaatgaaaatttaatgtggcctcccttttgggtttcacaaaaatatttttctttgttctcaagaagctagaaaattgagtttaactaaatcaggaagagatccttgtgggggagaggaaaggacttcatggcccttttttccatcctttctttgctgaggagggtgaatttaccaaagaaccaaaggctgggaactaagtaatctttgtggatgagatttttctttaaaattggctacatctgcaagagcggatgcctgaggcagcagtggaatgaggtcagtcgagtctacaagcagccagctatctgatctcaatagtttggggtctgagctgacatgcaaccctgctgagtccacctcacctccaccttgctatattctccccttcccacttcttctattcccccttttcctggcttctgctctgaaagcttctctccagttcctgagcaggggcagtagctgccctaacaggagctgaagctaagctgggtcttgctctaattgttcatttgtttcaggccagcagcctgttactgctagggctcagccactagaatactccaaactccaaggaatcagagaccttatttgtatgtttgactgtataggtccaatgcctagcatagttcttcatatctaacagatactcaataagtatttactgaataaataaatgaatggaagaatgacctgtaggccttgatccaattcatttgcttagtttactagtgtccttcatagtcgtggatccgtttaacaaaaattaatttctgtaatgagattatttctgtgaagagtcctggaatattttttacccagtcctataaatcagtgtttttcatttccttccatttgtttccagttgaaatttctggcatttcctctcttccatctaaagaaatgttacccattctttacctcatctcaatggctaagccttcactaaacctctctgatgacccctgttaaaagtggccattccctcctgtaaagtccaagagcactatggttgtaattcttttcataagtgcattatacaagttgcttccatatcctgtcgttttcttttttatccctatgtaaatgaaaagttctctgaaaaggaatttagaggagagagactatcccaataaacagtttgcaaacctgagagccacagatttcagtgtaaaaggaaggtttggctctattttaagttagtcctagttagccacttgggatccatcttgaaggattggttctttgaggtttatatttgtttgcacaacttccctgagtcagaatgttggacaaatgttattctccttttacaggtaatttggagaggttaatggatatgttcagttatacaagcccagaaaataatggaggtacactagaactcagatgtcttccttattcctgtaaccacccaatgggtttactttgctggctgtctagacagagccaaatttataaagacggggtaattgcaatagagaaagagtaattcatgcagagctgactgtgcaggagactggagtttcattattactcaaatcagtctcccagagcattcagggatcagaattttttatttatttatttattattattatttttttgagacggagtctcactctgtcctcaggctggagtgcagtggcgcgatctctgctcactgcaacctctgcctcccaggttcaagcgattctcctgcctcagcctcccgagtagctgggactacaggcacccaccacgcccagctaatttttgtatttttagtagagatgggatttcaccatgttggccaggatggtctcactctcttgacctcatgatgcacccaccttcggcctcccaaagtgctgggattacaggcatgagccaccgcgcccagctggggatcagaatttttaaggacaactcggtgagtagggggaagccagtgagctgggagtgctgattggtcaggtcaaagatgaaatcacagggagtccaagttgtcttgcgttatcagttcctgggtgggggccacgagatcagatgagccagtttatcgatctgggtgatgccagctgattcatcaagtgcggggtctgcaaaatatctcaagcactggtggtagtttttacaatagtgatgttagctccagcagcaatttggggagggtcagaatcttgtagcctccagctgcatgactcctaagtcataatttctgatcttgtggctaatttgttagtcctacaaaggcagtctagtccccaggcaagaaggaggtttgttttgggaaagggcttttatcatctttgtttcaaactataaactatgaattacattcctcccaaagttagtttggcctacggccaggaatgtacaagacagcttggaggttagaagcaagatggtgttgattaggtcagatctctttctcagttgtaattttgcaatggcggtttaattcccagtccagttctctttatactgctatgcaatgcatgtgctcatgttctggtatgtactattattctgtgtcagtgttatcttccctacaagattgtaaatttctaggacctaacttcttagacatgctaataatattaactaagtgaacaaattaatagaccctcaaaactttaaattcaggaatagaaaaaaaataaagctttttcttcctgtcagctgattttgcaaagggtataaggagccaaagagctgccacgttggtacagaagttggaaaacaccatacgcttcaactgctggttaatttttgctctaaaaacttgatggaggccaggcgcggtgactcacgcctgtaatctcagcactttgggaggctgaagcgggcggatcacctgaggtcaggagtttgagaccagcctggccaacatggtgaaacctcgtctctactaaaaatacacaaattagccaggtgtggtggcacgtgcctttaatcccaggtactcgggaggcagagggtgcagtgagccagagattgcgccactgcactcagcctgggcaacagagcgagactccatctcaaaaaaaaaaaaaagcttaataataaaatgggcttttatatatacaaatcagcacaaactcatttgagggagagtaagatttacctacttgctcacaactttttttcccctgcctcaggctcctgagtagctgggattacagggacgcaccaccacacccagctaatctttgtatttttagtagagacgaggtttcaccatgtcggccaagctggtgtgatccacccgcctcggtctcccaaagtgctgggattacagcgtgagccaccgcacccggccacaactttcttctgtgtaatttcaccttaaatacagccatttacttgggggtggagtaagcaaattgcctctttaatttctctcccggggtggtagaactgtggcattaaacagaagtgcgaacagaagttgagagtgggaagaaaggctgcccggaagggggtcaggaaagctcaggcaagcccaccctcaggcactacagctagactccgagcttactgggcagtcatctgattcgaccaacatcagttcgcagggcttaagcccagtcccttacggcggcctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtgagtcctgccagcggcccccacccctctctggctcccttgtagtttctgcttcagccccctctaccgcctcacccttgaacctttgtactcccccgcattcgctcacggtctgtgccctagcgctcacttgttcagtggagagaccgctttgtgctgggctttgacgcctgggcgtggaagacggagcagttctgaggatctgtctcctcaaggagcttccagtcttgtctgggacacaaaccagaaaacaggcaattgcaaatacagtaaaataagtgctgtatgtggattttcctatctcataggaggccctaaaaacgtcttgcaggggacgtggtgggatcagggacgcttcttggagaaagctgtagttaaaaattaagatctgaatgaataaaaacagtccattcagcaaggagaaggggaaaaagtgtttcgggtaccaggactactgtctccaaagtctccggcacagaaacagggcccagttggaaactccaagtggtgtattcaggatgaactgtagagctggaaaaaggaagggtctaacagaaaactgtccaacagaagcatattgtgagccacatacgtatttttacgttttttttttttttttttttttttgagacggagtctcgctctgtcgcccaggctggagtgcagtggcgcgatctcggctcactgcaagctccgcctcccggtttcaggccattctcctgcctcagcctcccaagtagctgggactacaggcgcctgccaccactcccggctaattttttgtatttttagtagagacgggggtttcaccgtgttagccaggatggtctcgatctgcttacctcgtgatccgcccgcctcggcctcccaaagtgctgggattacaggcgtgagccaccgcgtccggcatatttttaagttttttgtagccatattaaacaactgaagagaaacaggtgggtttgattttaaccatgtattttctttaacctgatatatgcacagttgcatggtaattttcaacattcaatatgaaatattgcccaagtggtggtttaggcttgtaatcccagcgctttaggaagcccaggcaggaggatcacttgaggccatgagtttggaggacagcctgggcaacacaggagaccccatctctgctaaaaaaaaaaaaaaaaaattagctgggtgtggtggtgtgagcctgtagtcctagctgcttgggaggctgggtcgggagaatcacttgagcccaggagttgaggttatagtgagctatgatttcgccactgcactccagcctgagagacagagctagaccctgtctccaacaaagaaaaaaaaatgaggcagtagagatttagaaagttttaagtaactggtccaggatcatccctggtaagtggcagatctacgattccaaatgctacactttttcccttatgacttgctgactccttagaaataaggatttctggatatagtattcagtgtatgatacagctgaacaagatcaggcagaagtaatccttttgtggagagtcgtaaaaatccgagtatcaggctttcaaggtagttgggagctgtggtaattggaagatagaactaatattggtgacttttacatgtgtaggtatttttacttggaagaggagagagtttacagaatccagagtaccacataggaagcatctttagtagtccaggtacttgaaggctaaagtgtaggccagtgattctcaaactgtctgtgtcctgtaatatcctgaaatcctgaagtcagattcatagacaataaaatctacctgtaaacataacttttaataatcaatataatgctttaattgagacataaaggtgaaatattttattagacaataacatgtctacaggctgcgagcggtgtctcgctcctataatcccagcaatttgggaggctgaggtgggtggatcacttgagtcaggggttcgagaccagcctggccaacagggcaaaaccgtgtctctactaaaaatacaaaaattagctgggcatggtagcacaagtctgtaattccagctagtagggaggctgaggcagaagaattgcttgaacccagggggcagaggttgcagtgagcggagatcatgccactgcactccagcctgggcgacagagcgagactttgtctcaaaaaaaagaaaataacatgttaacatgtctacaatttaaatatgtaaatacttagacattactacattagaaaacataatgaagtaattattagttgctgtcatattacaccaatttgtagaatcactgtgtatgtgacagctaccaatgcaaattgtttatcaaatgtattatattggcttttcaagtagcagaaggaccattgttctttacaaacttatttctcctaaatggtgaacaatttctggtaaaaacttgaacaaaacagtggaatctccctcaatttacatggcacttgcacttatggaagattcagtctgtactaaaacagtgtaataatgatatatttatatataatgaagttctggactaagattatcataaacttttcacctacttaatcttttaaaattgagggatgcaaacagttttttgttacacaggcttgtctcatatattttaggacttctacgatcaatggtcccccatccaccaaataccctcccttctattcaaattattgtgcaaccaaacagggcctcacgtactttcagaatgtccctaaggggttgttctgcttcttttgggagttgttggtccaggcaatgaccaataatgaggcagaagattgttgataataactttagggaacttggaagtactgaaagcaatgagaagctgacaaaaggtaaatattaggaaagaaaaaaaaatggcctaggtgtagggcatatttggaaatcttatggaaaatagaaaataatgtttgtcaatgagttaaagaaaaactttcacactgtattttaaaaatgtaattcattttaaggtttatgaaatatatcttgttgggctggacatggtggctcatgcctgtaattctagcaatttggaaggtcaggtgggagaattacttgagcccaggggttcaagacccagggtgggcaacatagtgagacccctgtctttctaaaagaaaaatcaaaaagaaataaatatatcttgtcatatttgttaaataactttttcttaggtaagcttctcttttgaaactaagaactaatgttcattagcctgcttaggagattaaaataatttttaaaaataggcaaaatatgtagcatcttgaataaagttagcattttacaattaatggtttaatagaagtcataatcaaactttgcactagcaaagctgtttctcatggaaaagtagaaaagaaactttaagagattattatcaaattttaaagcagtttgaacaaaactcagtttgtatgaaacggtagtcatttagtttccattactttcctgaaaactgtaactcttacttttatttttcttcaatttttattttaagttccggggtacatgtgctagatgtgcaggtttgttacacaggtaaatgtgtgccgtggtggtttgctgcacagattgtctcatcacctaggtattaagcccagcatgcattagctattcttcctgatgctctccctcctcccacccccacaactcttgttattattaggatagtgtaacatgtaaaaaaaactagacacatatatgtttcattataaacaatcctgatacgtgaaaactaaaacctgtcaaactaattttcaggcatttattcatttccaaaaataagacagtacttttactattttgcaatgataacatgatttaaaacatgttttaacaatactttgaagcttacattggtaatcacatggattatgtactgtatacccatatttttaacttttttttttttgagatggagtcttgctctgttgcccaggctggaatgcaatggcgggatctcggctcactgcagcctctgcctcacaggttcacctgagtctcctgcctcagcctcccaagtagctgggaccacaggcgcctgccaccacgcccagctaatttttgtattttcagtagagatagggtttccccatgtcagccaggctggtctcaaactcctgacctcaagcgatccaccctcctcaacctcccgaagtgctgggatttcaggggtgagccaccgcacccggcctaactgattctttcccactgttttttacaccataatgggaggctagaatgttaagtttcatggacagggactttatttgttctctggtatgtatttctagcatttataatggtgcctgatgtgtggtaaacattccaaaaagaaattgttgaatgaatgaatgttattcttgaatgggaagaaatgagaagaacttttctttcagtgaatggagtaagaatttccagatgtctaccagtgagtaccatacacaaaaatagaaaattcagcttatttaaaatgtagctcattatagtcttccctgaacatgctgattctcctcttctttccccctttcttgactagtgccatcatgtgcactttctcctttacctccaccattcagttcatgagtcacttagcctcatctctgtaatttttttcatggtattccttcccttgctattttcttagtctttattgtttctcctctggcctgtagtgatcgcctttaaaaacaagtctctttgcttctggtattgtatcctttctaaacttcacactgccatcagttatttttctacaacacagacttgttaatgacaccatccctttttatgagtttaacatgatctaaacctttcttaggatcttacacaggactcttcatgtactgatccttaaatgacatatccagccacatttcacatcccctacattgcactgtaccctgtactatagttacattaagtttccttcatgaaattttatggttctgtgactttactagagctttctcttctgaaattcttttcctggctaactcctattcattttttttttaaagacacatccagtgtgaagccttccctgaccccagttccctttgcctagtaggagaaaattgttttatactgtgtgtttccttaggaagttgcacaagtttttattatagtttattaagatacatcaaaattatttatatttgtataagcacctatggtgtgaagtcctcagggaagacacttgtatctgtatctgtgattggcattgtaattggcacatgatagccatttaattatttgtctatgaaatagctattaacttctattattattgagcaacttaataaataaacatggatatttgattttaatatcattgacacctgtattttttccttgtagggtcctcttatatgttagcctctaagggagagcaagagtctgtgtctctcttgctcactgctttttccccagaacttagcataagtcctggcacatgccaaataaatgtttatatatttatatggtaaaagttaaataagtatttgttgaatgagtgaatagtctacgtctttcctctctccatcacaactaccacccctcttgtgaggaggaagaatactttttttcttcttcatttccctctggtacaactcttgtttttcttggactgaaatgttcagtctcaaaatagaaattttagcattttataacactttcaggcaacttatatttatctaaaaagttatttactgcctatgttgtttagggagaataaaatgccatagggaatttgtaaacaattttggtgcctttttttttttccccagctgtagcagctatgatggagtgatcttttttcccagttttcagaaattttttgattcatggtagtggaacatttatagtaatttttctgtttttttaattgttgctgttgttattttggtttttttagtggatatttgaaaccaggtagtggtaacagatacctgacatggcccatttgttgatctgctggcattatttaaataatgtttcttctctttgaaatatgcctttttaactaaaattagatattctttatagatggggatgaagttttaagaatactcgttctctcagttcccaacatagtaccaggcacatggttgctctgcctcataaatttttgttgaatcattaaattaacaaatgaatgaaaccaacaggcttggagataagtagattagggaaatgttatagaatgatgaacggacagccttcaggaattaaaaaaagaataagataaatgagactatgcctctttgacttttgtaatagtcaggagaggcctaaaatgtcagtatctaataaatatgtgtataatcagagtacgtataatactctgacttctgatgtgctttttcaagttttgatcattgcttattaatatctccaataacacaggcagtctccaacttagaaataggttctgtttttaaaatttgtcaattaaattcattttaatagatttttgggtaacaccaaatatatggaagctataaactaagtgtgtatagggagggtataaataaaccaagattgccaccctcaagggcagaggatagcaaacttaatttgtaaagggttagatagtaaccatttcaggctctgcagaccatatagcatctggcacacatttacctgtgtaacaaacctgcacatctagctgcaactacactgttgtagactgaacacatagacaataaataaatgtggctatttatgaaaacagttgctctaggaggcaaatttggagcaaatttaaatgcccaattaaagacagtttctctaagtgctatcatatttttgttcatttatttattcatccatttaacactttatttatggagtcgtacattattaggtaaggttctgagtctaagtgctatagtggatacaaagatgaatcaaatacgcattttttcctcaagggacttgaccagaaactaaacctagactctcagactgggaactccccagcagtggagatcctgcctgattcacttttgagaatgacttctagggccaagcacagcacggggtaggttgcagatacttagtaaatgtcttttcaagggtaagggaatgaaagactaaggcataggtgtcataagagaaatatatggataaaatgcttgatttcgtaggaatgagccattgtttcttatttgggaaatcagagaaaactgtgaaaagtgagttgaatgagtagaacattgagaaaagggaagaatgtgagctaagttaaaaagataaaatcttaggcagaggtagcaaattcagatgcttaaagggggcagtcacgtggcacaaatgagtgaggggatgactgggttaaatggtgttgcattatgtgagtgatgattatagcaaaatgagagagcacttgcttttctaaaggaggcagatcattggaataaaccattattaccagatgtttgatttttcgaaagaaaccagaaagagataaataagtttttctaaaatgtgggttatatcaaggaagaaaaatagggaaaggtaggttgggttaacaactgtagatagctccaaatggcgggttaaggaatgtgtggactaaatttgtaggcagttaattttgtaggagttgtgtgatcagtggaggccttcaggagaatcaagcccagagcagtgtttaagaagggtagaaactaaacctagactcctagactgggaactcctcagcagcggagatcctgtagaagaggacaagcctagttgaaaatgcgttacagtgggcagtactttgggagtgtagaggaggagatgatggcagcaataagagtgatgatagctgaactgttttgtgccaggctttatgctaatgttttaaatgcatgaactcatttagtctatataataatcctagcaggtatagatcctgctaatattataaccctctacttgtagatgaataaattgaggcttaaagcactgaaataatttgtgcaaagtcacacatttgagaagtagatgaatcccagaggtactctgctttgttgcctctgtgctcttattcagaatattctctttgtttctctttccccttcaacttcttaaattatgtcacggtctaactaggaaaacatataacttaaataatataaaacaagggaaatgtaattcaaggaattggcttcatagctagtggagttgttgagaaatgaaactaggatggtgaagcaatccagagattgggaacagcaaggaaccactagcactcctagagctgtagggccaaagggaggagttggtgtttttcaaaaccactctacattaattggaaccacggatgtctgttcagggggagctggagccactgctgctgctggagcagttgctaaagacggagaggaaggggcggtaataccgtggtttcttccttgttttcactgtccagtctttcaccattgcatcccattggtctgactctactgggaccagctgacacaagagcctgtaggacttagctcttctaacagaacagagaatagcccaggaattgattggtgaatgcatatgggcctgcgaccaacacattatctgttttcagctgtaatttgaattccactgataataagaaatttgaaagcacagtctcctaaaagcagtgttagaaaacactttttgaaatgctaagtattcccttaatccacagtgtaagggtaacagtattattttgtggaattccatttacactgtcttatgtccttggaatatcatttccatgctattggagataaaataagtactgttgccaagtgtggtggctcacgcttgtaatcctggcactttgggaggccaaggtgagcacatcacttgaggccaggagttcaagactagcctggtcaatatggcgaaaccccacctttactaaaaaatacaaaaattagctgggtgtgatggtgcacacctgtagtcccagctactcgggaggctgaggcaggagaataccttgaacccgggaggtggaggctacagtgaacccagatcacaccactgcactgtagcctgggtgacagagcaagactctgtctcaacaacaacaaaaagaagtaagtactgttagcttataaagaaaagaggtttaattggctcacgattccataggctgtacaggaagcatgatgctggcatctgctcagtgtctggagagaccttgcaaaacttacaatcatggcagaagacagagtgggagccaccacttcacatggccagagcgggaggaagacagagacagggaggtgctgcatacccccagaaaaccagatcttgcaagaactcactatcacaggaatagcaccaaggggatggcgctaaaccacccatgagaaattgccgccatgacccaatcacctcccaccaggccccacctcccacattggggattacaattgaaagtgagatttgctgagggacacagatctgaaccatatcaagacaatatagtgagaccccatttctacagaaaacttaaaaaattagtcacttgtggtggcacatgccagtagtctttgtttcttgtgaggctgaggtggtaggatcagttgagcccaggagttaaaggttacagtgaattacgatcataccactgcactacagcctgggtgacagagtgagaccctactggaaaaaaaaaataaaccaatattgatccattattattaacccaagtcatattttattcagattcccatactttttagctgatgtcctttttctgttccaagatcccaaccaggtaccacattacatttagttttcgtgtctgttttggctgcttgtggctgtgacagtttttcagacttgctttatttttgatgaccttgacaggtttgaggcttactggttaggtattttgtgggatagtctctactggaatttcttaggtgtttttctcatgattatactggggttttaggtttttggaaggaagatcaatcagaaaggtgaagtgccaggctgggtgcagtggctcatgcctgtaatcccagcactttgggaggccaaggtgggtagataacttgaggtctggagtttgagaccagcctggtcaacatggcaaaacccgtctctactaaaaatacaaaaattagccgggcatggtagcaggtgcctataatcccagctacttgggaggctgaggcaggagaattgcttgatcctgggaggcggaggttgcagtgacccgagatcatgttattgcgctccagcctgggcgacaagagtaaaacttcatctcaaaaaaaaaaaaaaaagaaaatgacttgccagtttcatcacatcatatgaagtgtacatactataaacatgtttgttgcaattgatgttgatctaatctgatgcggcagtatttgtgagttttcttaactgtaaactttatttgcatactgcactttttgaaagaaagtcactttgtgcagcccacatttaaggagtagagagttatgctctccactccttaaatgtagagtaatctgtcagattatttggaattcttctgtatgggagatttgtccttttttttttttttttttttttttttttgagacagagtctcgctgtgtcgcccagactggagtgcagtggcgcgatctcggctcacttcaagctctgcctcccgggttcacgccattctcccgcctcagcctcctgagtagctgggactacaggtgcccaccaccgcgcccggctaattttttgaatttttagtagagacggggtttccccgtgttagccaggatggtcttgttctcctgacctagtgatccgcccgcctcggcctcccaaagtgctaggattacaggcgtgagccaccgcacccagccgagattgtccttttactcccatttattacttatttatattagtttggtttcatggatagtaattttatgctttggattataatccactaccacatttattttgttgttcaagctgttttatctttggccattgggatctctttcagttgactcttgtgtacctttgacatacccccaacgttgtgggggtttttttgagcacttccttgctttctggcactacatggtgctctaggctcattttgtgtatttcctgccccagtcccaaaatcaggcatttctccaatgagttctgtgtatataacattttatctcatggggagcttcattctgggtcataacttcagatcctaatccatttttatcctcccaccctcatccatttttatcctcccacccaaatgttccccaattcctttatcttttccctatatagctgatgaggtaagagcaaaagatatccttgtcttggtacacgtggctgctgctttcagtccatcaaggacagtagaatttttccctgaagcttcagtaaagcgcttttgtgtttgtttagtttgggctttatttttgtttttcaatatctggtgttagggactgctaatggagggagggtgctagggattgtgaaaggaattagagagagagaaagagactcattaacctttctgccatttgtcattgtatttcaagtttgttatagaatcttagtacaggtcaagtgaacagtaaagaacctgtctctgggtataaggttaaatattgcatattcattcctctaaaggactgaatatggtcttcaagagaatgattttcacttcttttggaatacctagaatttaacaatcaccaccacactgaaaaaatagtttttgtatagtaggcattagaactgaagagaactaaaccaagggagaaaagaatggtactttaaatagcactttcctccccaaataatgcctagctgcagtgatgttaaagtttaattcaaggacttcattactataagtacttaagagatttctatatttttatgtggtttttgaataatttctgtattgatttgtaagtaacttttttcaaagtaccaatttattttttaattttaatattttatttcttttgagacaggatcttgctctgtctcccaggctggtgtacagtggcgtgatcatagctcactgcagtctcaatttcccaggctgaagtgatcctcccacttcagcttcccaaggagctgggaccacaggagtgtgccatcatgcctggctaaatttttatttttatatttggtagagatgggggtcttgctatgttgccgaggctggtcttgaactcctgggctcaagggattctcccacctctgcttctcaaagtgctgggattacatgtgtaagccactgtgcccagtccaaagtaccaatttaattttacattttaaaaattggattctaaaagtctgccttcttatctgaacactatttttcagattccattttattttgttacttttttaaattgtgattggacaaaatgtttttcagtttctgtctttttttttttttttttttgagacagggtctcactgtcatccaggctggagtgcagtgatgcaatctcagctcactgcaccttccaccttccaggctcaagcagtcctccgacctcagcttcccaagtagctgggactacgggtcgcaccaccacacccagtgcagccctcaacagagaggagactggagtgggtagctcctatctgcaggcaggtcatcctgataagggtgtctggctaagtctgcaggtttttatgtgctcagaatggaggaagtgcatgttgattggttgatgggtggctggccatgggcaggcctggaaaaagcaccatccaattggccgattggtcatcaatgaacttcatactcctgttggtggacttcatccagaactggcagcctggcccctaggcttcaggccagtcctagcttgaaggaggggttctgccagggacccaccctttcctgcccaggaaactttcaacctcttgctgccaccaacatgacctccacagcaccctggctctagaggctgcggggagcccacaggcccatgccaagctactaccctcagccccttggctggacctccctcctgggcttgtgcccaaagtctagagggggctgaagtggcagggggctggcatgtcatcaccgctcttagtgcatgcacacccggctgggttgagacagtgcctcagcttagccacaactttgccccaccctggagtggatgccgtgagtcgggagaggccaggcagtgggagcaggcatttctaagcctgtaggggcaggggacttcctgggcccctgagagtgcggttgggcggctgcagctgctcctgggagcactggctcctaccctgccaagctgataggtggctggcctcctgcctgttcccagctcccggcagctctgctgaatgtccagcccccatggtgcctcccgctctgcagccaacatccttgtgggggccgctccagacgggccgtagcagccactgccttaaagtaaaatcggttgctgtaagggagtaaaagtagctttcattaaaggggatgatttcccaagcaagaagaaataagcaaaactacaaaatgttgcagataaggtgtacatcagatataagccgaaaaagagagtttgaggggttcttgctggagacttcaaagtcagtatgataaaagcttggagtacttgataggaaggaggccaactagagatgcagtgggatcatttttatgatcagggtgcagatttaagtgcaaggataaaaagggagacaccgaagatcaatgtagttattcttgaagaatgtaaggaagaattcatttttaaagtttattttaaagtagacaggtcagagggttttctgccttctgatgttaaaacatgttaaacccatctcaccaggtgagatcttcctttttctttttttaataacctttatttttacctcctgattttaaaaagacgattatgtaatgttatatagtaattgtaatagctaccatttgttgaatgtttatcccatgttaaatatactagtttatatatatgaatgccctaacttaaaaaaattcttatcaacccaaggaattaggtgcagtcatcatcctcattttacagatgaaggaacacatggaggtcatgtaacttgggcaggtcatggagctgacaagtaaggagccaaaactcaaaccatatttctttgattctaaagtctaatgatcccaagactacgttttaatgaaaatattcttttttatagcctgcttttattctgtacttaacatgtggttgctaaacattcctcaataatatatttaattgttgatccatattttacatgtgccttaatttatttaatgattcccccattgttgggtagtcagattgtttccatttttttgtattacaaataaaacacagtgatgaattttctcttaaatgtttttatggatttttctgattattttcttcggataaattttttgaatcttagttactaagcctaaagacattagtatatttaaggttgttgattcctgtgatgaaagtaacctcaagacacattgtcccaatttgcattcctagcatcagccatcagttcaggagattgttcattgaaccattcttttgacaatttgtaagactttgatttgttggccaaaatgtatacctctcatgattaacaggctgcgtactggaggtatgacagattgtcacatggccccatccagaggaaaagctgaaagagggactagtaatgccagtttcatacttatcaaacgattccatttttgtattaaacataggagtattaaaaatacgactggggaggccaggtgcggtggctcatgcctgtaatcccagcactttgggaggccaaggcgggcagatcacgaggtcaggagatcgagaccatcctggctaacacagtgaaactctgtctctactaaaaatacaaaaaattagccaggcttggtggctggctcctgtagtaccagctactcgggaagctgaggcaggagaatggcatgaacccgggaggcagagcttgcagtgagctgagattgcagcactgcactccagcatgggcgacaaagcgagactctgtctcaaaaaataggaaaaaaaaaaaaaaaaaaggaaaataccactgggggaagggagaccaaagaaaatttcatgaaataaagaattaaggacaccaaggactggtgctaggatctagcttgatgttagataataaaaatgacactgtattctctagaaaatttaaaaacctacctagtaataagttgtagaagactttatatgttttttgtgaatgggcagataggggtgttttgttgagtgtgagctcacactggaaaaaatcttgagtaatttttataatccattaaaggtaatgtgagagtgacttcagattgttgcttgaaggcataagctctggtctggaattaggatacctgggctctagtccagtgtagaattgttgctgcaatttgcaagtcatgtaacttctcgggccctcagtgtcttcctcataaaatgtgggttttggctaatgttctctgtcatttttttcaactctatgattccgtgacattgacttaatttattattacagtcagaaatgtcaacaaaacattcgtggaaactattgaaaatggaacagaaacatctttttgtataaaattatagtgtttctatagaagtctgtgtgtgcctttgcatgtacctttccatgcaatcaaacagaaatgaaaagtttccagaaaaggtcaacaagtaaatttactgaggggagaagtgtgtgattgagtgtctaggagtctcagggggtggagacaccaagggaaggctaatttgaagacataggcaaaatagttcagaacttaattcaggactttagaaattcattggccaaaaaattctaataaaatttcagtacaataataaaatgataaaagctgttggttgggtgaaaaaggccctttccttcaaatgttagaaaacaaaactaaggatactatttaaacttgaaagagataaatttggctgggcatggtggctcatgcctgtaatcccagcactttgggaggctgaggcagggggatcacctgaagtcaggagttcaaaatgaccagcctggccaatatggtggaacctcatctctactaaaaatacaaaagttagccaggcgtggtggcgtgtacctgtagtcccatttactcgggaagctgagacaggagaattggttgtacacgggaagtggaggttgcaatgagctgaggtcacaccactgcgctccatcctgggcaaaagagtgagactctgtctcaaaagagagagagagaaaaagaaatatatacatttaggactagtgaattaaatagcagggatgagcaagttaaagaatctcactcctagacccaaatgaaccttgagctgcctagaagactgaacctttgagagcagctgtatctgaagcttcaggccaaagaacagttctcagaagttgcattactagacttgacatgtgccagccatcaagacccacaaagcaaagatatagagcctgctgtagttctttcttcctaacaaattcgtttcaaatgctgaaggttttaaaatattttttctggcttaattttctaactagaatttggttttggctttgaaatttttgtctctttttgacttacctgtttatctgtgggggtaataatctgttacctggttatcatcttgaagtgaccccataatgttaagtagatggaagttgactttacattttacaagttgtctggtctaatctgtgtttaaaatattctgcaggcctagtctgtttttaacatattctatatgaaggggtggtttgcccctccacacctgtgggcgtttctcgttaggtggaacaagagacttggaaaagaaagagacacagagacaaagtatagagaaggaaaaaagggggcccaggggaccagcgttcagcatacggaggatctcgccggcctctgagttcccttagtatttattggtcattcttgggtgtttctcggagagggggatgtggcagggtcataggataatgagagaaagtcagcagataagcacgtgaacaaaggtctctgcatcatagacaaggtaaagaattaagtgctgtgctttagatatgcatacacataaacatctcaatgccttaaagagcagtattgctgcccgcctgtcccacctccagccctaaggcagttttccccatctcagtagatggaacatacaatctggttttatactgagacattccattgcccagagatgggcaggagacagatgccttcctcatgtctcaactgcaaagaggcgttccttcctcttttactaatcctcctcagcacagaccctttacaggtgtcgggctgggggacggtcaggtctttcccttcccacgaggccatatttcagactatcacatggggagaaaccttggacgatacctggctttcctaggcagaggtctctgcagggttttgtgtccctgggtacttgagattagggagtggtgatgactcttaaccactgctgccttcaagcatttgccttcaagcatttgtttaacaaagcacatcttgcacagcccttaatccatttaaccctgagttgacacagcacatgtttcagggagcacagggttgggggtaaggttacagattaacagcatctcaaggcagaagaatttctcttagtacagaacaaaatggagtctcttgtgtctacttctttctacacagacacagtaacaatctgatctctctttcttttccccacactatagatatttaacatgtcttgtagatgatccctgcctcccaacacacacattgactagattgcagtaacagtgaggtgagggcagaatctcagtcagaattcaacatctaacctttgttctctccctgtatcctcacatttccctccttggcctaaccttgaccctatgcttcagttttagttctacttttctaagaagcaatctatgattcagaagtagagtactcagccagctggccagctgtctgttttactgtctctccatgcatatacatacatccatgcagtcaattaactgctaacttttatttagcctatgctatataccgggaatacaaaggtgaatgaagcctacctcttgccttctagaggttcatagcatggtgagggagggaagttttgaagtgtggcctgggatcacaatggaggagtaagctgggaagtagtcaggtggtgatatttaaataggtaagaccataacactgacattgatttctttaatggttggatgtttacttaatcctgctgcctatctatagtgtagtaggccccctcttatctgtgggttctgtgttccaagaccaccagtggatgcctgaaaccatggaaagtactgaaccctacagatacagtattgttttcctatagtactggtcccttcatacacaatgttttttcctatatatacataattatgataaagtttaatttataaattaggtacagtaagacattaacaacaaacaatgcaatggaacaataataactatagttgtaataaaacttatgtgagtatggtctctctttctctggaaatatattattataaccatggaaagcaaaactgtaagagaggactactatagttttgtttcttcctccttcttagtagctgagaagcaatatagagcaggcactctcctgtgttagggacagggatcaatcataacatctttacatgaagggtggtgaaacagaagggcaggagtgcattaagagtcaactaggatggggggatatgactcaagtgctccagctcccaaactgaaagccagcagattcaaaagagggagagcttatcttgagaaaaaatgtcatggtgccacataaggtagggaccagctgtggtggtgtagctggcaagtctaaaatttgtagggcaggcccacagtctgagagctttcagataggatgagattcttgaggcagtatttcttcttcttcagagaaacttcaattttgttcttaaatccttgcaaatgattggtccatatagattggcccacatagattatcaaagataaactccataggtgttagccacatctccaaaatactttcatggcaaccccaaaatcagtgtttgactaactgggtaagcatagtgtagccaggttgacacataaaattaactgtcaccatgttcctgggttcaagaacttaaagccaaatatgcaacctggtttggcaagcctgtgatgagttcaggggctgcaagtgctctccaggctgtcaggaaggacatggttgatgacaggagcaagattttctgaccagtcacatttattcacattttggtttaaaaaagctgctttttaaatttgtttatttttatttttttgaaaggctctgtcactcaggccggagtccagtggtatgatcttggctcactgcaaacctccgtctcccgggttcaagcgagtctcccccctcagcctccccagtagctgggactacaggcgtgtgccaccactcccagctaatttttgtatttttagtagagacggggtttcaccatgttggccagactggtctcgaactcctgactctcagttgatctacccgccttggtctcccaaagtgctgggattacaggcatgagctgccatgcctgacctcaaaagcttcttatattatgagaaagtagagccatgactcacactgttattttgagtaaatgcaaaacagtacttaaaagatcattcttgttattatttatttacttattctagaccttttctgacagtgtgaaaaagattattcttaaaaaatcattatctatagtgaagatttaactttgaggagtttttaattatgctggagagtggagtaacattcatttggggtaagcctaagagttttgtttcctaacatgtttggcctctgattttgttgtttcgcccttttatttattcactagtcttgctgtagatactaatgcttgcctgtggtttaagagaaattaagcaacttaaaaacagagcaaatagaaatgtagttagctttgcctttcttttttgcttaatgtaagggtttcgtgggaattggtgttttgggagaagttcaaatgtatttgcttttggcaatggaacaataatggtaaaggtagggtgtcttaatgtagattggttcaatttagatatgaaagtctgaaatttatattggcttgaagattttagggcaggataattttataaattctcgttattgtcattttattgtgtctgacactttttcttgaatgtaaattctcctcccctccttattctaatctgcatgtataatacctcttttacccaaattatattgatttgccagcagtctttcttgtttcctctctttttttctcctttccacttgctgttgtttaaattcaaagagttttctttgtggagactgaacctaatagtaagacagcataaaacactgagttcagcagaaagtgatttgcttgtgattaacccttgagaattaactcactgcaagataacaaagaatgaatgttttccaaacatctggctcattcttcttttccattagtagatgagacctctccatttaccctctaggtgttaggaattctcatactgtttcacttaggctttatcatactcgtcacggcatattgttagaaagtaagtccaaaagagagttcatgacataccctttctctgccacagacctctcacagtccttgcagcaaaaggcagttagtgtcattcttttagttgttcaagacaataaccttgactcttctcttttccttttagttgctcaagacaactaaaaggtccttttagttccttttggttgcaaagactttattttctttgtcttccgagagacttttggatatatttacctggtccagggtattttgaagcatgaccatatgttagattcttaattacgtttaactagcattgtccattatattttctcatttcaaaaccttgactccatatccagtgtctcagcaaatcctattggccttacctccgaactctatctagtatctcaccactttcctcatttccatcattaatcgctgtagcccaagtgaccattatctctttcatggattattttaatagacttacaactcatccccatgcctctgcttttcatcctctacaatctattctcaacatgacaagtagaatgatccttagaattttaattgaaataatcttaggcctctgctcaaaacaatgatgtactgtatcactcggagaaaagctagtctttatgttgaccatataaggcccagcatgatctgctccccttgtgacctgttcgaccttgttgcctatttttttctctttctcttcctgctgtatgcacactggccttctggctattcgttaggcacactgggcacacctgtgctttagggactttacacttgttcccattgctagtccaaaatctaaggaatcctttttcttgctttaatttttttccaaaagtcatttttttcagtgaagcttgccctactcactttaaatttgttgctcttgtagcaggacaagccgcaggcaaaacctctcagacatcgagttgtagaaggaagggctttattcagctgggagcatcggcaagctactgtcttaaaatccaagctccccgagtgcacaatttccgtcccttttacgggcacacaacactaaagattttatatgaaagggttgtgattgattgagcaatctaggggatatgtgacggggtttcatgcactggtagtcagagtgaaacagaacagagcagggagtttcacaatgttcttccatacaatgcctgaaatctatgggtaacatcgggttctaagtcatgagttgatttttaactactaggtttaggccatgcaggctcgggcgtggttttgggcctggggccaggctgcctgtctttgatttcacttccttgtttttttcttaaaacaggtactgagtataaaatataaaacaatgtgagagggtctctctcttccctcactctcaccatacaaacacatacctacttctttatctgcttaatttttttccatagcacaaatcactgcgtaaaataattatatatttttcctgttaaaattgtttgttgtctgtctctcttgctaaaatgtaccttcatgaggatagggattttgtctgatatatccctagggcttaaaatcatgactggcacatagtaaatactgagtatttattgaattaattaatgaaccagtcagagatgggaaatagccttcaagtgcctgtttgctaaattacctaacctttttattgggagtttattttccttaatgtttgtttaacaaattagttattctttcatgttttccacataacctgtggattatcttcatttttttttttttgtaaggaaatttaccagacataaggtcctaactttattttctttgtcttccgtgagacttttgaatatatttacctggtccaggatattttgaagcatgaccatatgttagatttttaattaagtttaactagcattgtccattatattttcccatttcaaaacataatttcggtcaccagtatggtacacataaaatatgagctacaagagacatctcggtggtggtgagagacaggactagttggacttcctaggccgactaagaattcctaagcctaactggggaaggtgaccgcacctacctttaaacacagggcttgtaactcagctcacgcccaaccaatcaggtagtaaagagggctcactaaaatacaaattaagctaaaagcaggaggtaaagaaatagtcaaatcatatatcgcctgagagcacagggggaggggcagtgattgggatataaacccaggcattggagcagagagtgggcaaccccctttgggtcctctcacattgtacgggagctctgttttcattctattaaatcttgcaactgcacactcttctggtccgtgtttgttacggttcgagctgagcttttgctcgctgtccaccgctgctgtttgctgccgtcgcagacctgccgctgacttacacccctctggatccagcagggtgtccactgcgtttctgatccagtgaggtgcacattgccgcacctgatcaggctaaaggctcgcctttgttactgcacggctaagtgccctaatcgagctgaacactggttgctgggttccaccgttctcttccatgacccacagcttctaatagctataatactcaccacatggcccaaggttcaatttcttggaatctgtgaggccaagaaccccaggtcagagaacaaaaggcttgccgtcattttgggagcggcccaccccatgttgggagctctaagaccaaagacccgcccgtaacagtggtaaagtttcttaagatcattttcatgtcattatacaaacttttagaaaatgacgctttgctagattttggaaatccaaagaaataaaacacagtccctacctccggaagcctacatgttggaagggatttgaaataggtaaatgagtattaactaatgtaatatatattacagtagaaagatctcctgagtactatggagtactgaagagttttgtttgggtgagaggtgagtgaagaaagcttttttgagaagatgagcttgaagttgattgctgagtaagatttcccaggagtaaagcagagaggaacaaaaggagtaagagtaaataatatgagaatgaaaaaaggaccaacatggaatgtctgtgacgttcacataggtgctggttatttttcataaccttgtttgaatcattacgagcatgttaggatacaggtatttgtatcttaattttatagatgaggaaatgggcccaaagagaatagcttaggatcacagaatgttgaattggagcccaggcctgattaacttgaagcccatggactttccatagcagccccatacatagcattcaggtgtgaaggagtagaaagtataaggggctcatgcttgctgcatggatgaaaaacttgaaggcttatttagaaagtaaaagtttagtacgagccatgaggaatgggaaagggtactaattaatgatgaggaagatgatggtacagagtaggcttgaagggccagcgggcatcagaaaccataactgtgtaatgatgctatttagtgagaacataagatttttctttagctagacctagcagtctaggatgaggattctctgtggtaactctgccaccattttgaaaccattcgatttcactgacaatttgccatctgttgctttctgcagtgctattatgcatatgcctggaagtttttaaatccaaaatattcatgcattgtatatggtcagagagaatgcagtgaaagctatgctttttgtaatttttgacaagtgtactctaaagtaatgaattttaaaaacttaggccgggtgcattggcttacgcctattatcccagcactttgggaggccaaggcaggtggatcacctgaggtcaggagttcaagaccagcctgaccaaaatggagaaacctcgtctctactaaaaatacaaaaaaaaaaaaaaaaattacccgggtatggtggctcatgcctgtaatcccagctactggggaggctgaggcaggagaatcgtttgaacccgggaggcggaggttgtggtgagccgagattgcgccattgcgctctggcttgggcaacaagagcaaaactctgtctcaaaaataaacaaaaaacaaaaagcttaaatacccttgtcccatatcacataaatttgttttttgaatatatatcatctttttttcccccatggtgaccatgacagattattaaaaactaaatttctaaatttgatgtaagtagaatgttaggtttttggtttttcttacatagagaccactgttcccaaacattatgctggaccagttgtaaaagaatttttttggtggcatttgtaactgatttcatttttaagtatatatgtgcatatatttatagaaagatcagcttgttctataagtagaagtatgtggtaccctaattttgtgtaacaacaacaaaaatatatccaataattagattttctgcaggcctagaaaatgttagctacttttttaagccataaacgtctgaatcgtcagataaaatgtttcaaaactaaaacttgcccaaggcagccttgtgaatttttttttaaagaattaaaaaaaaagcctcatatggcatccatattcatcatctactgctacatatgtgtgacacttacggcagttttagcctatactagggtacaggaatatacttacttttttaaatcatacttcctgatttcttttattttcatatcccaatttttcctaagtcaaagaaacagcaacatttctgtttctgcagaatttaacctggttattgcctagttggtagaaaatgactgtagttgtggtaccaacactatgcctgattcaccattttactattatattgtcttttcaatgtcattttttctcattctgttactggcagtttagttttaaagcatcattgtttaaaaaacattcaaaataaaagtcgaaatacatcttcatgtttacaactggatcagatatggtgttgtgcatataaaagaaacaaaatacagatcctcttagcccaaggatatgatactgaagtttagtaaacgagaaatagcatagtgatgaaagcatgctaattgtttttcaacaatagtaaaatagagaacatgttaatggaattatctgatatttacacagttatgccaagtaaaccataggttattcagaaaccccagtgtgttttagatgttattttatttttaaaattaaagccaaagaaaggtatggtcaggagttctgtgttgagttacttacttagacttagattgactccctttctcttatacttctgttttctacatttgaaactagtttctttttcctgtttgagtcattcatatatgtggaagtttgaggagaattgttactgttttacagctcacaaaatctgtgtctgaaaagaaataccaatggctttttagcaaataaaaaaatgttaggtagtagataaatttttttctaggaaacaattcatattattctgggccagttaaagttttgtttgtttgtttgttttattttatttgtttgagacagagtcttgctctgtggcccaggctggagtgcaatggcatgataatcggcacactgcaacttccacttcccaggttcaagcagttctcctgcctcagccttttgagtagctggggctacaggcacctgccaacacacctggctaattttttgtatttttagtagagacggggttttgtcatgttggccaggctggtctcgaattcctgacctcaggtgatccacctgcctcagcctcccaaagtgctgggattacaggcatgagccactctgcccggccagttttaattgcttgtaaatctaacagccttactatttccacaggaaactttataagtacttttattctttcctttaaaattttaaaaaattttttagtttttttgagacagggtctcactctgtcaccaagctgaagtacagtggcataatcacagctcactgtggcctcaatctcctgggctcaagcaatccttccacttcaggctcccaagcagccaggactacaggcacacccaactaacttttctttagtagagacagggtcttcttgtgttgccgaggctggtctcactcctgggctaaatcagttctcccatctcagcctcccaaaatgaagacttttattcttacttcagattacaaaatatgattgtataggatacatgattaaaaaaaaatttcaagttgatttcaacttctaaatatgtttttgtttgtttactgtcaattgttcatgctcaaaaagttttattttaatatcaaattaaaatacaaagagaggtaatttagattaaaccctttcaatagagaatttttaagatttaaaaaatttttttagccttgatttgaaattgaataaggaattttaattccagtaaataaatgggtttttgattagctgtgctgtattttatcgttttagtgtggataagtaagatttgattgctcaattttggttatttactgaacatccttttttactctagtgatctacctaatttgggtttctttttgttgtttttgtttcttggtattttatttatttttttgagactaagtctcactgttgccgcccaggctggagtgcaatggcgcaatctcagctcactgcaacctccgcctcccaggttcaagggattctcctgtctcagcctcccgagtagctgggattacaggtgcctgccaccacacccagctaatttttttatttttagtataagcgatggggtttcaccatgttagcaaggctggtctcgaactcctgacctcagacgatccacccatctcagcctcccaaggtgctgggattacaggcgtgagccactgtgcccagctattttattttttatttcaataagttttgggggaacaggtggtgtttggttacatggataagttctttagtggtgacatctgagattttagtgtactcatcacctgaacactgtacccagtgtgtagtcttttatccctcgctcccacccattacctgccctgtgagtccccacaatccgttgtatcaattcttatgccttgcatcctcataccttagctcctagttataaatgagaacatacaatatttggttttccgttcctgagttacttcgcttagaataatggtctccaactccatccaggttgctgcaaatgccgttatttgttcatttttatggctgagtagtacttcatggtgtgtgtgtgtgtgtgtgtgtgtgtgtatatatatcacattttctttatccgctctttgatgagcatttgggctggttccatatttttgcaattgtgaattgtgctgccataaacatgcatgtgcagtatctttttcatatgattgcttattttcctctggttggatacccaagagtgggattgctggatcaaacagcagttctacttttagttctttaaggaatcttcatactgtttttcataggggttgtactagtttaccttcctaccagcagtgtaaaagtgttccctttcaccatatccatgccaacatctattattttttgattattattattatttttttgagatggagttttgctctgttgcccaggctggagtgcagtggcgtgatctcggctcactgcaacctctggctgcttggttcaagcgattctcctgcctcagcctgccgagtagctgggattacaggcatgctccaccacagccagctaatttttgtatttttagtagagacagggtttcaccatattggccaggatggtctcgatctcctgaccttgtgatacacctgtctcagcctcccaaagtgctgggattacaggtgtgagccaccacgcccagcctattttttgatttttaaattatggccattcttgctggagtaaggtggtatggcattatgggtttgatttgcatttccctgataattagtgatgttgagccatatgttttttggctatttgtgtatcttcttttgagaattgtctgttcatgtcttagcccacttttttttttgagacagagtctcactcttgtcactcaggctggagtgcagtggtgtgatctcagctcactacaacctccacctcctgggttcaagcgattctcctgcctcaacctcccaagtagctggattacaggtgcctgccactacacctggctaatttttgtattttagtagagacagggtttcaccatgttggccaggctggtctcgaactccctgacctcaggtgatccacctgccttggcctcccaaaagtgctggattacaggcatgagacactgtgctcggccattagcataatttttgatggcattatttgtttttttcttgctgattagtttgagtttcttgtagatagtgtgtattagtcctgtgttggatacatagtttgcaaagattttcccctactctgtgggttgtttattctgctgattatttcttttgctgtgcagaagctttttagtttaattagttcccatctatttatattagtttttgttgcatttgcttttggctttttgatcattcaggagcaggttatttaatgaaatctttgcctaaaccaatgtttggaagggtttttctgatgttatcttctataatttttatgcttttaggtcttagatttatccatcttgacttgatttttgtataaggtgagagatgaggatccagtttcattcttccacatgtggcttgccagttatctcagcaccatttgttgaatagggtgtcctttccccactttatgtttttatttgctttgtggaagatcagttgactgttaagtatttggctttatttctgggttctctattctgttctattggcctatatgcctgtttttgtaccagtaccatgctgttttggtgactatggctttatagtatagtttgaagtcaggtaatgtgatgcctccagatttgttctttttccttagttttgctttggctgcatgggctgtttttttggtgccgtatgaattttaggattgttttttctagctctgtaaatgatgatgctcgtattttgatgggaattgcattgagtttgtagattgcttttggcagtacagtcattttcacaatattgattctatccatccatgggcatgtgatgtgtttccatttgtgttgtgtgtgatttctttcagcagtcttttgtatgatagttttccttgtagaggttttttacctccatggttaggtatattcctttgtaattttttgtttgttttttctttgcagctattgtaaaaggggttgagttcttgatttgattctcaggttggtcactgttagtgtatagcagagctactgatttgtgtacattaattttgtatcctgaaactttgctgaattcattgatcaattctaggagatgtttgaaggagtcttcagggttttctggtatacaatcatatcttcagcaaatagtgacagtttgacctcctctttaccgatttggatgccctttatttccctctcttgtttgattgctctggctaggacttctagtactatgttgaatagaagtggtgtaagtgggcatccttgtcttgttgcagttcccagaaggaatgctttcaacttttctccactcagtattatgttggctgtgggtttgtcttttattaccctaaggtatgttccttctatcctgattttgctgagagttttaatcatgatggaatgctggattttgtcaaatgctttttctgtgcctgttgagatgatcgggtgattgttgtttccacttctgtttagtatatcacatttattcacttgtgtgtgttaaactatctctgcatccctggtatgaaaccctcttgatcatagtggattattgttttgatatgctgttgggtttgattagttagtattttgctgaggttttttgcatctatgttcatcagggattttggtctataggtgttcattttgttgttgttatgtcatttcctggttttggtattagggtgataactggcttcatagaatgatttagggaggattccctgtttatcttttggaatattttcaataggattggtactagttctgttttgaatgtctgacaaaattcagctgtaaatccatctggtcctggacttttttttgttgacagtttttttgattaccatttcagtctcacttattgttattggtatgttctgagtttctagttctaccttgtttaatcttggagggttgtatatttcctggaatttatccatctcctctaggttttctagtttctctgtgtaagggtgttcatagtactcttgaatgatctttttatttctgtggtattggttgtaatattgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtatttaccccagacaacgaggctgcttcagtatctcccgtttcatttctaatttagcgtatttggatcttctctcttcttttcttggttaatctaagggtctaccaattttacttatcttttcaaagaactgaaccagtttttgtttcacttttgttttgttgttgttgctgtttcaatttcctttagttcttctctgatccttctttctattctcttgctgggtttgggtttggtttgttcttgtttctctttttccttgaggtgtgaccttacattgtctatttgtgctccttcagaatttttgatgtattacatacattttgatttaatattatgaactttcctcttagcactgcttttgttttatcccagaggttttggtaggttgtgtcactaatgtcagttcagttcaaatacttttttatttttcatcttgatttcattgttgacccaaagatcattcaggagcaggttatttaatttctatgtatttgcatggttttgagggttccttttggagttgattttcagttttattccactgtggtccgagagagtacttgatataattttgattttcttaaatttattgagacttgttttttaattttttttttttttttagaaggagtttcgctcttgttgcctaggctgaagtgcaatagtgcaatctcagctcactgcaacctccacctcctgggttcaagcaagcctcccaagtagctgggactacaggcatgcaccaccacgcctggctaattttgtatttttagtagagacatggtttcaccatgttggtcaggctgattttgaactcctgacctcaggtgatccacctgcctcagcttcccaaagtgctggggttacagtgtgaaccactgtgcccagctgagactcattttgtggtctatcttggagaatgttctatgatgaatagaatgtatattcttgcagttgttgggtagaatgttctataaatatctgttaattccatttgttctagggtatagtttaagtccactgtttctttgttgactttctgtcttgataacctgtctagtgctgtcagtgaagtagtgaagtcccccactgttattgtgttgccatctatctcatttcttaggtctaatagtaaatttgggagctccagtgttaggtacatatatatctgggattgtggtattttcctgttggactgatctttttattatataatgtccctctttgtgttttttaactgttgttgctttgaagtctgttttgtctgttgtaagaacagccactcctgctggcttttggtgtccattgtcatggaataccttttgctacccctttatcttattatgtgaatgtgaaaattgttttgtttaaggaggctaaatataggacccagattccttcttgatcgtagggtttctgctgagaaatctactgttaatctctgataggttttcctttatagattacctgatatttttgcctcacaacacttaagattctttccttcatcttgactttagataacctgtgtttgtgcctacatgatttttttgcaatgaattttccaggtgttcttagagcttcttatatttggatgtctaggtctctagcaaggccagggaggttttcctcaactagtctctcaaatacattttctaaacttttagatttcccttctttgtcggggacaccagttattcttaggttatgtcatttaacgtaatcccaaacttcttggaggctttgttcctttttttaaattcttttttgtctttgtcagtttgggtcagtttgaaagccttgtctttgagctatgaagttcttttttctacttgttcgattctgttgtaactttccagtgtattttgcatttcctaagtgtgtctttcatttccagaagttgtgattgttttttctttatggtatctatttctctggatatttttatccatatactgtattatattttaaatttctttaagttggttttcacttttctttggtgcctccttgagtaacataataatcgaccttctgaaatctttatctgacaatttagagatttcttcttggtttggatccattgctggtgagctagtgtggtcttttggagatgttaaagaaccttgctttgtcatactaccagaattgtttttctggttctttctcgtttgggtagactacgtcagaggaaagatctggggctcaaaggctgctgttcagatccttttgtcccatggggtgatcctttgatgtggtgcactcccccttcctctagggattgggcttccggagagccagactgcagtgattgttactgctcttctgggtctagccacccagcagagctactgggctctgggctagtactggggagtgtctgcaaagagtcaaacacagatgtgatctgtgtttgagtctctcagctgtagataccagcacctgctccagtggaggtagcatgggagtgaagtggactctttgtagttttgtttagtgagttggttttcttgaatactgggtactagtagtacagttgttacatggacagactcaggacctctggttagccaggatgctacaggcagtggaaatagctgttttcttttttcttagagtgtggttgttcttttatgagttgctataatggcttgagtttgttggcttctagccaggaggtagagctttcaagagagcatcagctgcagcagtatgggggatacaagcttgccctaagatcacctggataagtatttggttttctcagctgatgggtggggacatagagctcccaagagattatgtcctttgtttttggctgtggggtgggttggtgtgggtggtggaaggcggcagtgtgtagagaaggatcaccaggttggggaagggtgaggcttgtctgactcagattgtccttgggcagggcttgctgtggccactgtggggtatgggggtgtggttctcagcactgggaatttgccccaggctataagcctcccactgagaaagcaagcatggctttcaggctccctgcatgctgcatcttctgtgttcatatctgcacttcctgtttgaacctctcccaccccttcctccattcctcccaggaaaattcatgctcaattgaaattatcacaaagttcatctggaactttccttctacctgtggtccttccctaattccagtggcaaccctcccgaaggacccctgtgagataaagtcagaaatggcttccctggggaccaggagtgcttatagggctcttcctgctgttgcttctacttttaattttcgctcagctctcttcagctctaggtaaggttaaatcctactgtttcctggattttcaggttccccagtgaggatgcatgttcagaggcagactccccctctcacactttgggcacttaacggtttttctgctgtctcatggagtctgcaatggcaagctgctgctttcaaagggtctgtgaattcttttggttttcctgatatgtttctggagtagttcttggagcaaaagttcacggtgtgagtctccacatgctgtttctgcacgtccgagtgggagctggaagttagtccagcttcctctccaccgtttttttctttttgttgtttttaaaggttacaaggcctttgtttttccttctgtaaaataagtctttagaagtagtctattaattttattattaaaaactcaagtttttattacattattattgaatgaaaaagtaaaatatatgtgacagaacttctgatgtgctctaggagttgaagattgaatgagatatccttcagtgagctcatatatttatatttcttcttctctttctttttttggagacggagttttgctcttgttgcccaggctggagtgcaacggcgcaatctcggctcaccgcttcccgggttcaagcgattctcctgtctcaacctcccgagtagctgggattacgggcgtgcgccaccatgcctggctaattttgtacttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgagcaacatggctgtttatttcacctgggtgcaggcgggctgagtccgaaaagagagtcagcaaagggtggtggattatcattagttcttacaggttttgggataggcggtgcagttaggagcaatgtttcgcgggcatggggtggatctcacaaagtgcattctgcagggtggggagaatcacaaagaaccttgttaagggtgggagagattacaaagtacactgatcagttagggtggggcagaaacaaatcacaatggaatgtcatcagttaaggctattttcacttcttttgaggatcttcagttgcttcgggctatctggatgtatacgtgcaggtcacaagggatatgatggcttagcttgggctcagggacctgacattcctgtcttcttatattaataagaaaagcaaaacaaaatagtgaagtgttggagcggcgaaaaattttgggggtggtatggagagataatgggcgatgtttctcagggctattcgagcgggattaggggcggcgtgggaacctacagttggagagattcaactggagaaagattttggggtaaggggtaatattgtggggttgttagaaggagcatttgtcatatagaattattggtgatggcctggatgtggttttgtatgaactgagaaagtaaacgaaagacacaaggtccgaataaaagaaggaggaaaataggtattaaaggactaagaattgggagtatccaggacatccaatcagagagtgtccaagggggttcaacgttattgtttgcttggttggcgagtttttgggctctatccttgagttttttatgttgtcatataccaggccagattgatttaggtaaaaacaacactcttcattaaaaaatatacagagtcctctttaacagtaagtcgaggccttggtgattttggaggaaagagaaatgcaaagccagcaactgtttgttgaagaaggattagaaacgtttgaggtaaaaccaggagccactaaataccaagagcctgagaaacagcttgggtgatttgactaataaaggccggtctgttattggactgtatagaggtgggaaggccaaactgaggaattatgtctgacagaagggaagaaatgactgcggtggtcttctcagatcctgtgggaaaggcctctacccacccagtgaaagtgtctacccagaccaagaggtattttagtttcctgacatgtgagtaaagtcaatttgccagtcctgggcaggggcaaatccctgagcttgttgtgtagggaagggatggggcctgagaaattcctgaggagtagcagaatagcagatggaatgctgagaagtgatttccttgaggatagatttccacgatggaaaggaaatgagaggttctaagaggcgggctagtggcttgtaacttaacatggaagaggttatgaaatgacgacagaatagaatgggcctgtgaggctggaaggggatattttccttggtccaagaactatttgccttgtgtgggaagagattgataggtggaagtttcagtgggggagtgggtgggagtggtcagatgagaaggagaaaagggatagaagtttgaacgctagctgcttttttagttaccttatcagcataagcattgtcctgagcgatgggatctgatgccttttgatggctgcttttttagctaccttgtcagcataagcgttgtcctgagcgatgggatctgatgccttttgatggtctttgcagtgaatgactccagcttcctttggaagtaaagcagctttgagaagagtttttattaaagaggcattgatgatggaggacccttgcatagtgaggaaacctctttctgcccatataacatcatggtggtacaggatatgtgaagtgggagcaggcatttcaaatggcggaaagcagtacaagagagggagagtgtggtgggaggtgccacatacttttcaatgaccaaatctcatttgtattcagagcgagaactcacttatcaccaagggaatggcccaagccgttcattagggatttgcccccatgatctacgcagctcctgccaagccccacctcattacatttccacatgagatgtgagtgtggacaaatgtttaaactataaggataaaaagcaagatctttaggagataagcatagagatttaggagattagcctacctgtcatgttcaagtttctatgtaggactcatatgatatagacccttgggccaactttaccctgttgcatgccccgtctctcacatgcaatacagtgactggtatgtagtgatgattttatcagtgaggatcctggtagtaataggtggattttttttttctttttgaagatagtttattgaagggactgttttcagaggtgtgaccatggtttaagataaccaagaaaggatgatgaatcacttagggactagcagcacttggaaactgttattcatccaggtgacagggcaagggtagaaatcatgttccagaactcagtgagagttgtaggcatgaaagaggagccttctcaacaggagctgtggccaaaaaagaaacaaggcaggtaagaaatggggaataaattatgccattatttctctttccttccactctttctttttctgctgatgcttcctctcactggtgaaacccaaccagaagctaaatggcaagtgaatccctagaaataaggcaaggcagagatgcagagcaaggcagataaaactagaaaatgggtctagggggagacaaatggaaataatcaacagagtgctcaatacttatttgttgaattaaactgaatttttattgttaaagtggaaaacaagcaaatgcctgatggtttaatgttttcttatatacaaaacttgaaataaaaatctctttgaaattttggaggcaactatttcatcttttgaatggttgaaatagtaaaaatgttgcaatacttaatctataaaaaattaaatactttatatttttcttttttcttttcttttttttgagacagagttttgctcttgttgcccaggctggagtgcaatggtgcagtcttggctcactgcaccctccgcctcctgggttcaagtgattctcctgcctcagccccctgagtagctgggattacaggagcccaccaccatgcccggctaattttcatatttttagtagatacggggtttcaccatgttggccaggctggtcgcaaactcctgacctcaggtaatccatctacctcggcttcccaaagtgctgggattacaggcatgagccaccacacccagcctttattttttgagagagtctctcatctgtcgcccaggctggagtgcagtggcacaatctcagctcactgcgacctccaccttccaggttcaagtgactctcatgcctcagcctcctgagtagctgggattacaggcacacgctcccatgcccagctaatttttgtatttttaatagagacggggtttcaccatgttggcaaggctggtcttgaaattctgacctcaggtgatctgcccgtcttggcctcccaaagtgttgggattacaggcgtgagccaccgcgtccagcttttattgatagtattaaaagcagttcacatttactgattgtttgacatgtcccaggtcactgtgctaaatcttttacgtgtattcttatattttatcctcacataaccctgtaacgtgtcaatactgttgctatactgttgggatgcatcactgtacaaaacaagttccacaaaggccacagatctttataatctgatattaatatttctataccattctgttgttattgttagtattctctggttactcttgaaattgagcgccttttcatatgttttagccatttaattttgtgtgtgtgttttgtgaaatcactgacttagtcttttgcccgttttctatttggttgtctttttattattaatttggaggaagcctgtgtatatttggatatgtgctattagctatgtgttgcaaatgacttctgccatctgggagattcaagctgaggtattaagagcaggtaggatttgggtaggcaaagatgagtgtttctagtgagatgaaagaataaacaaaattataagggaagaagatataattcacatattaaatagttgaatagtttgattggactaacaccagaaagctcaaaatatgtagcaccagggaagcgctagaaaatggcaaaaatatacctcagcagaacatttgctttaaatcaatacgtcttctattcaggaataacctatttcaggcaggctagacaacctgaaaggaaccccaaagatagtttgcctctctggtaggcagctctaggctttcgctcctctgccagggaatgaatcttcttttactgaaatggccttgctgtcattgccttgtgaaaaggtgtgacttaaaactggaactgatgaggggagaagcctagaggaaagtccttcctcttgtcctccggctctagatttctcagagtttttgcatattaaagttagaacaccttcatgcggctgcccttgctgacctgatgtttctcattatagagtcattccttgaaggttgggactttgatttcctatgacttggtgtatatttccctacagaacttgaatgccaatggctgaatggctttttggttttagcctccctttagtctcagcctccatcttactatgtctgcaccaatgaagaagtctattcattctgttccctagggagattatgctagtgttttaaaagtctctgccgactcttcaggatttgcctctcccaccatttatcagacaaaaatgtttctgtggtttcacttcttaattttgtatccattagaatttgttttggctccaagtgcctaaaacccaaaaatatagtggcttaggaagatggaacttttatttttatcccatgtattaataaataaaggcaattcagggatgggaaggcagctctgtgatcatctggaaccaatgtcttttcatctcattgttcttcctactttatccaagagggttgctccagcagcaatgtatgcattccagccagcaggaaggagaaatggagaaggacatctccttacccctctgtaggacttctcagaagttgcatacactactctggttgtatcttacgtgccaacgcttagttagcatagccatacctaaatctaagggaggcttggaaaaatatatctagctaaaaacaggaattcctgatcatattgaaaaaaaaaaaaaaagagaatggatattgaggattaccattgatccttgccacataaatcttttgttattgtgacactaatagtttcctgagatgtttaaggagaaaagctcagaatattgtgggtatatagccaatttaaaataaattatcatcagaattagcttatatctgacattctgaattttggacccttattttaaaatttttacactggtctagaaggtagaccttaacttttgaattttttatcatttttgataagtttggaagcttgacttctttcctaaacattgatgtaaggtttcatgaaatttttaagtatagcaaatgctgttgaacattgcaaatgtaaaatatggaggaggaaatatgtgctttttatctttatagaagataaatatattaaaccccctattaaaaatcgtctatagaaaaaattatagcaataggtagtataaaagctctgggttagagtggattcaaatatatggaaattaaatgaaaatctagaatcagttcactgagaattagctgatacagtgagcagcagatataatcccatagacactgcatatttttttaagtcctgatcttcacagtagagcttaaagaaagtgtagtattgtaatgtaattattctcattattaaaaatgatttacttttaaaacccagcatgttacatcataagtaatattcattttttcttccataggtaagaagtttgatagctgtaggactgggtgttgcagctcttgcatttgcaggtaagataaagaatacataccaataaattgcaggagaaatctttccaaatagcatctacagtgattcatgagtagacccttagtattctgaggttttggttttcagacataatacattctcattctttccaccatttgtagttactgaacatttgtcattgtagcaaaatctagataaactttatagggaagaaaattagtgataaaaagccagaaaaactagctccaataatagtttattcctggcattttttttcagtttgaagtatagtatactataaaaagaaattttaatattatgcaatgtaagtggcatggagtgcctttattctcccatatttattttttcttgcagacaggtttatacattttaagctgtcagttctttctcatgagcatagttgttccgtgtagtttattgatttgtctctaaacatattggtataattaccttgataaaccctggggaatttttttcactgctaaaattacgtttttcgaaagaatagttcttttttttttcttttttttggaatgggcaagactgtgccccttccagaggctctggggagaagccctttccttacccttcctggcctacagagtttgccttcatccttggctcatggacccttcctccattttcaaagccaacagcttagcatcttccaacctctgtctgactgtcactctcctccttctctcttaaaaagattttgtgattacactgggcccacctggataatcaaggatcatctccccatctcaagatcctgaacctaatcacatctgcaaagtcagttttattacataagggtaacatattctcaggttccaaggattaggacatggacatctttgaaggccattattcagcacagcacaatgctagtttttcttttttttgagacggagtcttgctctgcccaggctggagtgcagtggggcgatctctgctcacttcaagctccgcctcccgggttcatgccattctcctgcctcagcctcccgagtagctgggactacaggcgccagccaccatgcccagctaatgttttttgtatttttagtataaaaatacaaaatttagccaggatggtttcgatcgcctgacctcgtgatccacccacctcggcctcctaaagggctgggattacaggcgtgagccaccgtgcccggcccattcgaaagaatagttctgaagatctaaagtaaatttgctgagtctgtcattaacttacagcagttttaaattacatagctatatcctaattaaatgttaatttgagaatatgtccttattgataaagatttacttttttgttctagcatttgtgtttgtaagttctatcggtttgatcttgttaattggctcttttaggcagagctgcattccattttggctatatagagtttagtaagatctgatagaaaaatgagaaataagagggtcttgttttgtatggtatttattttctcacaattatcatttaaaacactattttaaccttttgtcttggaaatgatgaaacacttcaacaatcagaactttaaaatctagatcagtggttcagattctcttgatgtttttgtcatcaaggtcttatgtctcagttatataacttatacttaatgaatttctgaggttttatgagaagaatatcatgtctcaaacagaattctgacaaacttgcccctaaacataaaggaattttagtattaattagagtaggcatagttatgaattcaaatgtaaggttttgatttgaaattagataaagatgtattttttccagggtcgtctttgtaaaatgacaagaattggtgtgtgtattctttatagaccacaccattcccaaactcgtattactgactagaatattatattaaataacaacaagatctcttccagagccaaatacaaccaaataatagaatttaggagaaagtacacttagatgtgttagaactaggtcttctagttagagtaaacctccaggtgtcacttcttgaagcatttaactgctttttaactgagattagaagtcagtcactgtggttttgaagaattttgaggtaatataaaagctacatttcatactattataaaatcaaatggaagatgacatctatgtgataagagatacaggcaagttagggaatcagcctcatttaatttcactttatttaatgttctcctttatctcaagacctttttatcttcacattttcccatttctggcatcctgtctttcactgtaacatgtttgcacagaataacagtatacataggcaggtaaatttttctaaaacagtatacataggtagttgaatttttgcagtagaactcttgatttgcaaataggcttatggttagaagttgaattaaagcctgtagtgtcatatactggttttctagcaagactcttggagaaagagatactagtagaagacacaatctgattggggtgcaaaagataaagtagctagataatattttactcttatttgatgccctcaaaataatttagaacctgttttactattgactcttagttgttaaaactcaggggagttttgattattgggattcccaactagggaaagaactaaaaataagttttcagagagagtagccatcctcagtgagaaaaattgataattaacatccttggtaagtatttcatatgtaattgcttttttactttagagataattgattaaaaccatttctgtgtagtatagatcataaatataatttgttttctatatatttcaaagtgattatcataaaaagcaatacaattaaccattttagtattataagtatcttttatatgtaataggactttacagtttgttgtataaagaatactaggatgttattttttttgtgacctataccataatataaatgtaagatattacacataaacattgaaaatttctagttttatgatcataaactagaacttgataaatttaatggctatgataatggtattaacatgaaattttgccctccaataaattaaaaatttgaaaaaattgaccatctttctggtaagttttgaaatacttattgcaataacatatataaactatcaataaatactgttgcaagcactttgaaggtgttgattgattttgattatagaaaatacatttgcttttattccctttactatttaggtcgctacgcatttcggatctggaaacctctagaacaagttatcacagaaactgcaaagaagatttcaactcctgtaagttaaacgtggctttagttagaagactcattttgatttttgttcatatgacatatttcaattaacttagaaaatgtcttggattttccaatgtttgtagaagtttgtttccttcactatatcattggtgagtttgtctaatttactggctcagtttcttttaagttattggtcacattatttttatatctaactttattcctggttttgacatctaattattataatctgtttagtagtattacatcaaatttgatgtaacttactttacccgtttagttactgttcatttattcaataaacatttagtgagtcccccatccctgtgccaggagcttggaatagctgatgaacaaagaagacatggttcttgtcctgatgaagcttatccaagagttgatgccatcttgtaatttgaaactagtccccttataccatcatgcctggccatctcaaacataaaattatgagatttcaaccatgaaatcctgtagaacttattatacatttttgtaccagcattatagctactctggggagctgaatgtaagtgaaaaaatgaatgagagtatgtatccgtaaaagcaacagtatggattgtagtttgtaaccactgaagacaatataaagaaaagtcagtgaggccctgcagcgtaaacattggcttcagggaaacagaagcagatctgggatagatcaacttggttgagacttgagattgtcaaattgctgcaaaccaagttgatcatccgctattctgctattctgagttcctggcacagggatggggactcactaaatgtttattaaataaatgaacagtaattaaacagggaaagtaagttatgtcaaagttgatataatactactaaatgtaaaactactaaactacctactttatatatgttatttcaataaatatttcaaaacttaccagaaagactgtcattttttccaaatttataatttattggaggacagaatgtcatgttaataccattatcacagctattaaatttatcaagttctagttcatgatcataaaaccagaaattttcaatgtttatgtatagtatctttatattatggtataggtcacaaaaaatgaattgcttcttttagcaaagacattacaggcttgtgaggcttagttagccatgaataatgacagcaccaaaggatgacatactgacaaataattaaacttagattcaaaaaaacagcaagtgattttacagtcctataaatgcatgtctgtgattagagggaacataggtgtattttctgttttcctatttatattttatttggctaaaatattggtaggtattcagtaaatattctttgagcacctactacatactacattaccatagacagtgggatatagttatggaccaaagacattgccgtctaggagcttacatgttagtggagagacacagtgtaaaaaaaaaaaaatgaagtaagatatataatacctaaaagtgtcgagtgcttttgagaaaaccaaatcagggtaagaggttaaagagtaacagcaatgaggaatctttaccttagataggccaggtaaggtttctccaagaagataagggagcaggccatacaagcctctggtgtaagagcttcctaggtggtgggatcactgcaaaggtcctgaggtgcaaatgagtctagcagcaagagtaactccaaaggagtatatgaagggaatagtggtagcttgggcccagatcccttagggcctaatagacaatgaaaaaaaacttcaaattttaccttaagcgtgaaagaaagcccttggaagggtttgagcatggaggcaatgtgatttgtattttaagttatcactctgcttgctaccttagagccagagtagaagctgtgaaaccagtaagcgggtattgagatagtccgggtgatagatgatggtggcttgaaatagagtagtagcaatggacacagtaacatagttctttaaatgaattctatttatatatttccatatgtttataaataataaatggaaagaatttcagaaatcgtttcttttctgttacggtgatcttcaatatagtgtaaatagaaaattaccaagctgtgcaaaactacattatttaacattgtaaaggaagagagagcaagaaaatgagaaaatcttcagtagttggtagaggcttacagataaggccgggtaattcaagagattataagggatatactcatgtaaactctttattcagtggctcatatgacctgctccctcatctcagaggagccttacttaagagtctgagcctggtacctgcgtttcttaaagggaaatgatgtgtgtacccccttttccctctttgtggggctcaaggtaagaaacttcgccttcaataaatctggcttctttttcacaaagtgctactcttaagagtttgcagtaaaacatcttagaatatctttatcattgtcataatcataattatatttttacctcaggaaagatgcaagtacttttaaacaattttaaaactagtaatcatttccagggaaactgagaaatgaaatatgtgcatactttctgttggtactaatgaatcccagtgtcacacctcataaacacagtatacacagtgttttgattttgtaaatattattaattattgaaccaaatagggttactaaaaagacaggaactgtaattgtgggtcactaaatctctgtcattcaaaaaagattgtccaaggctcaagtttcaacggggggtctcttttccttgtttctttaaactttatttgctttctctaagctttaacatgttgtttttcaatcttatctctttttcatacttttttttcatcttgctgaaatagtgccttggataagtcttttatatggaatgcatggatggtaaatgtattttctgctttgttaaacagtttgtttcttttgttctcactgttaattatcagctgctagctccttgaaatctggtgaagccaacattagagaagtatagaaatctctgctgagactaagccttagtgcctgaactcccgcattcctgcatactcacagctagattttttggtggtcttattattcttattccattgtagacaacctattgttttggttttcttttgttgtttgggttttggggttttacattttggtggtggtggcttttatttttagctctgaaagtttgtaggattttctctttcttactgatgttctggaatttcacaagaattcttagtgagccctaacttatttgaaaatggtctttagttctgtaagattttcttacagttttttcttttattatttcttcctttcattgtctctcttttctgcttctggaactctgaacagagagatgagaaagatgttggacctgataaaaagatgtctgtcctctatgtctcttaccattttatctcttattttccatctccttatctttctttgctcttcattctacagtattttcacagcttattttccagatcaccaggttggcctttagcaatgtctattctgtttttcatctatccaccgaattcttcacatcagcattttttttttttttttggagacagagcctagtagtgcggttgcgcaatctcggctcactgcaacttctgcctcctgagtttaagtgattttcctacctcagcttcctaagtagttgggattgcaggcactcgtcactattcccagctaatttttgtatttttagtggagatggagtttcaccatgttggccaggctggtcttgagcttctgacctcaagtgatccacccacctcaacctcccaaattgctgggattataggcgtgagccactgcgcccggccaacgttagtaattttctaacttccaaggattctttcttgtttcttttttctggcaacccattttttaattaatgtggtatccttttgaatatttctaaagccattaattagcatttggccaaattctcttctgcttcctaatttatctccttttcctaaagtcagttgttatgtgttcatattggttctttttttcccctccatgataattgggtttgctcaaatgtccagtgatccttggttgttgattcatatttatgatgactaaattgactaatagaagtaatgttcttgacttttcttcagcagtttggtagggttgcttcaacagcttaattgaatgacagtgttgacagtgggctgtaaataacataggtgggtttgttaacaggcatgtctttcagagcaaggagactagaaggcagcattggtacctggagagtccaggagaggttgagcaccgtgtatattttactccttggcatagcttctcacctccctaggcttctgggttctgaaatgggatctgctggtatgcctctttggttctcttagtacctaccacccaaaataagatgcgtatcagaaaaagaggcatatggttctctttctcagcctgagggcatgacaggtacctggcctcttatgctctatatgagtagagtaggaatgatctgtttatattgttctggtttaataagtttcgctgatttttttattgttgttgactctgaatttagtgttcttgttttcctgaaaagggtttctttttttctctgatgtttgaagctgctgggatttttctgtacatgcaaattttacctaggatttctttaaactttctggtttgctatttatcccatttcttgttttctaggcctattaagggtgttttaaaatttacagtgtctttactcatttcaaaggcacttcggaaagcaaaagatctttatgattcagtctgctcttttgaacaagtgcccttttgcttgtttttttgttttttttttaaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaagtcctaatataatgcaatgtgggtatattattttcaagcttaaaaggacctttcagttttattagtggggaggagtacagagttacaattttgtgctttctcatgacatagatattaattcaaacataataatggattaaaatactgtgataacagttttgttctatttaaagttatataagacctaaattttctagaagtttaggaagcatgattttctctgaagaaatgtgtaaatacagttgacccttgaacaacctgggtttgaactgcacaggtccacttaatcatgattttaaaaaataaactcaatgagccctccatgtctgcaatgaaatgtagatcaaaaatgtagtattcatgggatgcaaaactcacctatgctgaggccaactttttgtatctgtggtttctgtagggctgaccgtggtgcctgagtgcagattttagtatgagtggtcctggaaccagtcacccacagatactgagggttgaatgtattttagtagtgtgtaacatagcaattttttgttttctctttgtatacttttctgcacccagccccacatgttaagtctctattctcaaaatggtctagatctttttggaagggttgtgttgattatatgtatatacagattgacttactcgtaataaaatcagtgttcatatgaacttcttcccgacactagatttttggcagccttttctgaaactctatgtctacctgggcaaaactgaaagtgaaaaaattgctcagataccaatacctgcttttaagattaatgagcttggtgactatagtgggaatgacagtttatgaaacatgataaatttatcttttttattatgctggctccaaattttagagctccctaaggtaaataaagactcattgaaatatttttttcctgaataaagaattattctatgtagtagttcaggcatgatttaaaaacaaaagtaggagcaaatatttggtgatacttctgttttgttatgactaaatcaactaattacctttaatttagggagtaacgtatgcatctagtaaaaattttggtttcctgaaagaaaccttaaaaccagcccctattcctctaagtccctcgttttttgagacagtctgtctccattgcccaggctggagtgcagctgtgcactcacagctcactgcaacctccacctcccagggtcaagtgattctcctgcctcagcctccagagtagctgggattacaggcatgcaccactacacccagctaagtttttgtatctttagtagagacggggtttcactgtgttggccaggctggtctctaactgacctgaggtgatccgcccgcctcagcctcgcaaagtgctgggattacaggcgtgaggcaccacagtcggcccccttacttctttccatttgtatctgtatctgtatttctctctctatctctctttatatatgtgcatactctctatgtatgtttagaaagatataaaatttgttcaggttagtatgtgtgcttaacccaatttgattatccttcctctcctcaaaacttgtgtcaggggtgggggactatttgtttttttactggattataaattacttgaaacttggagagtatattatattctcacagtattgattcattgatagattagcatctgtgtgatgaaggacagtccttgatctctcatttgaaaagtgcctggtacacagcaattgctgaagtgtttattgaatgaattaattgccaggaattatttattaccaagtagaaatttataataagctgttcaaagagtatagcttatataaatggccagatctgactccctagaacccattttttaagctctagtcatttccttagtttcttttagtattcttctttctttaattgtataaatagcctgtgctcattgttgaaaatttagaagttaaaaacaaagaaaaaattataatcccaccagctaaaaataactttaaagttatatgctttcagattttatttcatgtaagcatacctatttttccctacttttgtaaggaaatggtttcatgcttagaaacgtttaatgcctgtaatcatatatgtgtatgtttcctcctaaaagctaagtttatacatcctgtttctctgtttagagctactgaaaatagtgtctttacttgctgtctccattcctttctttccattctgtcttaaatacactctaatcatacgctcacctcactttctgcagctcttctcagtttttgatgtcctctttgctaaatccagaggtcagtttgtggctctcattttactttacctattagaaactttgaaaccatttttcatttcctcactcttgacttgtagttaccatcctcctttactgctaggccttgtcagcctccttgactgattcctctccatttctataccacaaagtgttgcagtctttagggaagactccttggacttctaatttttaaaccatcttacttcagtctcatggctttaaatgctatctgtacactaatgactctcaaatgtaaagtctgatgttaagtcagacattctccacttggatatttaagacattttaaacttagtatatccgaaatcattctcctcatgtctgttattcacaacaaataaacagctgctcctttcctcagtcattaaatggcaatttggcagtttaggccagaaaccttgaagtcatttgcacagcttgggttctctggaaagcagagtgagataaagattagcaagctatacttttattaaagagtgctcttagcataaacaactccagaaagaaagggaaggacaagttaggcttcagtgcattcctacaaaagcctcagccaatctcacaataacctctaagcaaggatggctcattgtagttatcccaagttggggcaaggggtcataggattaaatgacattacccaggaagtgagcatatatataagaagtccaaggactgaaccctagagaaatacaatgtttctatcccatgtcaaccagtcagtagatacaggctgccctgcaaagtgggataagcttgacttcctttaggcaaggcaattcctaaagtgtctgacagctgggagctatcagccagccacagccccagtgtctggggagtaagtccttcacgcctgatggggatctgatgagcacataacagtgtcctcaacatcattcttaatttttctttttctcatatcccaaattcaatccatcaaggaaatgttagttctgttttaaatatacatccagaatctaaccacttttatcacctcctctgctaccgccttagttcataccatcatcatctgttgtctggattattgttatgttttctgaactggtctgctacttctactcttgcacctttctattctctacatggcagttagattaaatcgaagttagattgttattccagtgctctggcttctcctcccacttaaaattctaaattccttccattgtttacaaggccatccacagtctggttcccattatatctcgagtcctccttttctccttgttcacgcctctccagcagcattgaaaccttttaatccagcttcccagcctctcttggcttgcctgtctgctagtgtgacatactcccctcttcattagttcctccccattctctgttggctagtgtggtaggctaaacgatgtctgccatatcaacattaaatgacttcatcaaggttatccaatgagaaaagtactacagagcttagaaaaagttcaagcattttgcttctaccagtctgttttgttctttctgttgtatcttggtgtagaaaaattaatctgttttaaagtgaaaaaaagttagtattttttaagacttcatattggtcaaaatttcttgaaaagtttcattgtttggtgcttccccccgccccataattttgagttgacttctagtaaaatgcattactctcactgcagctacatgatgagattgaggtcatgccacctcatacgtggaactaatgatttcttgctctttctttcctatacagagcttttcatcctactataaaggaggatttgaacagaaaatgagtaggcgagaagctggtcttattttaggtgtaaggtaggtgtgcagcataagtattgttttgttgtgtggccaagcttgtctttaaaaaagagaaaacgttacaataaggttatacttagacttaaaattatgagtaggtggcagaggagaaaatatcaaatttttatattttaaagcctcaaatctaaaagtatcccactcccctaaaaaaacaaaacaaaacaaaacaaaaaaacaggcaaagttgtgaagtacctttattctttaacaaggatctataatatttgaatactgatgtttcagttaaccaaaatatccttttttgtgacattctctctagactcagttttataatttgatatcatattgttaattataatccaggatatgtttcatagttcttttctgcttctgcagtgtgacatcaagcatatttattgtgcttgtttcaccttagtatccttttattgtctaactttggacaatatgagagaaaattaatgatattatataattgctgtgtgatatcatttaacatttaatgttaagaatattttcccctatgataatcatttgtttaccatatgttcccttagagcctactctcaagtttttgtgggaattggttacagtatgtcatgtacaacaaatcttctgatgatataatcaacacaattaagcaaattagataataaagtcctgtattgacaaaaatgttttgatatcttgtaaattttttaaaatttaaagattttttaaaaagccaaaacattttattatttcttatgacctagcagaaaaaacaagagttgggaggaggagcccagtttagtttggtgctttatttaagagatctcatctcttcttagatgagatctctccttaccagacaatagaaaataggaaatgattttaagcatgagggtcagattaggaagtttgctatactgccaactatttcttgcttaatatcattcagaatggcattgttatttttcctgaacttttattggcctcccaaaataccctgttgattatcttgaaatctgagtataaaacattataaaaccaagtacaaaggtttttgaggatatcctttaatattatgcagggcacttacgttgttaggacagacaggagttgactgtatttttacattctcttaagatatatatttataaagttttatcccatagaactgaaagctgtataaaattcacttggaaaattcagtgattaagagcacagactctggtatcaagtatatatgcgtacaaataccagtttaacacctattaaatgggtgaccccagtttaatcatctgtaaaatagagataatagattagttttaactgcataaagttgccgtgaagattaaattatataatatatgtgaatttctttttttggaagtttttttcttttttaaacttttaggttcagggttacacgtgcaggtttattataaagataaacttgtgtcacaggggtttgttgtatagattattttgtcacccaagtactaagcctagtacccaatagttattttttctgctcctctcttacctcctaccctccaccctcaggtaggcctcagtgtctgtttttcccctcttactatttagctcccacatgtaagtgagaacatgtgatatttggttttctgtttctgcattagtttgctgaggataatggcttccagttcatccatgtttctgcaaagcccacgatctcattactttttgtggctgcgtagtattccatggtgtttatgtaccacattttctttatcctgtctaccactgatgggcatttaggttgattccatatgtttgctgttgtaaatattgccacagtgaacatatgtctgcaacacatggtacttactaactactcaataaatagcagccaagcaaagcagattattgccctgagtctgtcgcttaggcgctgccctgtatgatcttggtcaagcttttttgttttgttttgtttttagcttttctatactttggcttcttcatttttgaattgagagtaataatattctgccttgttggaataatataagaatgatatgatgatacctttttacataatacctaccaaatatcaggtgctgaaaaaaatttggctcctgtttctttccatgtctgtcacgaacgcagaagctagatatttgtcctaacacattaagtggaaaggtaaatgaaacttatctgctttcctctagccctttcttttcagtcaggcaatgttgattatgacaagataattttaagatgtgagtatattcattgaatctcagctgtgtagactatataacaggtaggtgaaggcaaaatggagccgatccttttgataacctattttaaaaatactgtatgtgttctagatgatactatacattctgacatattgcatatgagaattgtttattgaaatgtgtatttgagtctttgccttatgtttttccttgcaagagaatagtgtcctgcaatatgactcatgtctgtaacaaaaagcctgaattattttacaaagctgcccaggaaaattgtttttatacctggtatagtaagtcctcacttaatatcacccatgggttcttgtaaactgtgactttaaacaaaatgactataatgaaaccaattttttaaatcaatgaaaggatgttgaaggaaatgacattattcagggacctgccatacatcattttgcttaaaatcacagtttttaagaacctatcaacagtattgtgtattatatgaaatgatgcacatttatgatttttttttttgagacagagtcttgctctgttgcccaggctggagtacagtggcacgatctcccctcactgcaagctgcgcctcccaggttcacgccattctcctgcctcagcctcccaagtagctgggactacaggcgcccaccaccacgcctggctaattttttgtatttttagtagagacggggtttcaccgtgttagcaggatggtctcgatctcctgactttgtgatccgcctgcctcagcctctcaaagtgctgggattacaagcagaagccaccatgcctggcacatttatgatttttaagctttctaaaaacttttgtagaattctgtttataaactatattagtccattctcaagctgctatgaagaaatacccaagactgggtaatttataaggaaaaagaggtttaatggactcacagttccacatagctggggaggcctcaataatggcagaaggcaaaggaggagcaaaggcacatcttacatagtggcagcaggcaagagagcatgtgtaggggaattgccctttataaaaccatcagatctcatgagacttagtcactatcatgagaacagcacaggaaaacccgcccccatcattcagttacctcccaccggttcccctcccatgacatgaggggattatgggagctataattcaagataagatttgggtggagacagagccaaaccatatcactatatgttactcaaaagctcagtagtagaaaaaaaaaaagatgaaaccaaaactgctccatttgccagaaggtccaagaacaccactccacatacccccactgccagccagatgcattctagggaggtgtttgaaatctctggtctaggtaccatcatatttaaagttatactggaggtatatcatcatagctacatttagtttttatactaagcttaaaaactaggcttctctcatgttgtttaatctttacagcaacaaacatgtattaatattaaaatgtattaaggtccaagagacttaatataataataactaaaaggaaataaacactgccagcaaagcagaataggtctcatttccagagctcaccattaggagtctgatcattattatcttaaaggcagagtgttttgaatgccatacttgtgcatatgaactttccttccttgtgtttactttagttcagtggttggtggacctcagtatgcataatgcgttgtggagttttatgtacaaaactatgtggaactgattttcagagcattgtaattaattatcaaggaaattttgacggagtaattttcagattttgtattatgtgctcaactaaaacttaatatctagaataaaatggaccttgccatatatcttctaaaaaaatacaatggttcagcagaacattcacctatatatatatatatacacacatatatgtgcgtatgcgtatatgtgtgtatatatatgtgtgtgtgtgtatatatatatgaaatttggattttactgaacttatctcattatttagagggccacatggtgatgaaatttatgaaataggtttttaaagctcccccttttttactttaaaattatttgcatagtaatcctttataatattagtatttactaatatggagtatttgttattttaaggagtttacctttttacagtcatttttggagggtgatgtaaaatgcattaagcacttgtacgatatataatcctaatttcttttttttgtttttttttgagacggagtcttgctctgtcacccaggctggagtgcagtggcgctatcttggctcactgcaagctccgcctcctgggttcatgccattttcctgcctcagcctcccgagtagctgggaccacaggcgcccgccaccacgcctggctaattttttgtagttttagtagagacagggtttcaccatgttagccaggatggtctcgatctcctgaccttgtgatctgcccgcctcagcctcccaaagtgctgggattacaggcgtgagctactgcccccggcctacaatcctaatttctattttaagatacaaatcatagtttcagccctaaagttatttagaatctacctaacacaacatgccaaatacatacagaacagctagaaaacataagtaataaaggcaagatgtgccacagagcacctgtgtagcaaaaaaaggagttgataaatgtagattagccacagaaatcgaaatcattgagctgtaatttttcagtgtaattttttttgtttcttaataggcagttaaacagtatagtgttcatacctctggtatgatgtttaacagttattttctcaaaattcagtagtcttttaaccagacaatgtttaattgtttatctgggaggtacctacaagccaaaaagtaagtttagaatgctgcttcaaagacataggtaaacagccaagaggaatactcttaagtccttataggaaaatatttaattcattttactcatggaagactattttatgtgcctactcagcaattaatagtgcattttaatgtgcttggtgatctatcacttacccacagatcagaggtagcaagtaactagcaaggaactgccaaagactagaacaatagcagaatcaaggattgacagctgatagcataggggaggcactgttcaaaatagaacttaaatgaataacattctaggtccatttagtaggaggacaagcaaacatctgcagaccttgagagtttaattggtaataatgacaatgctgtgagccatccaagaaatgttaagttaggttatttacactttattttcaaaatgcaggagatatctaatacagtctcataagcatcctttactttcatgtgtgctaggttatgttaatctttttacttatattatctaatttttctttaaaataaacctgggggtaggttttattacgtgtatgctacgtatgagaaaattgcaactgagtttaagcaagacatactttcacagctaataagtagtggaatcaagaatttgaacctgtttctgactaactgtaaaagcacatgcttttagctattatgttgtggttcatccatgcaaattaaattattttgagctttacaataattacactgtgctttaagtcaactattattatccccatttgagactcagaaaagttaagtagcttaaacaagatagtatagctattaagtagcagtagtaggattttgttgttgttagtgttaatttttttcccttgcctagaaaatgtactaataagcaacatttccaatactggatacattgggttttacccaaataattttaggattatttaattatctactttaatttttgtttacagcataggctttaacagccaagcttttcccatgggtttttttcacaaagctaaataactatgagacataaagagttttgagatcctctgtaaaggtaaaagataactataatgaagcacttgctacattccaggtactgttctaacatttcgtaggcattaactcatttaatccttacagttgctctagccctgttttacagtgaggaaactgaagcaccaagaggataaaaatttgatcaagcttacacaatcttaagtggcaatactggcattaaaatccagcagtgtgccaggcgtggaggcttacacctgtaatcctagcattttgggaggccaaggtgggtggatcacgaggtcaggagttcgagaccagcctggacaacatgatgaaaccctgtctctactaaaatacaaaaattagccgggtgtggtggcgcgcgtctgtaatcccagctgcttgggaggctgaggcaggagaatcacttgaacctgggaggtggaggttgcagtgagctgagatcatgccactgcactccaacctgggcaacagagcaagactcctccttcttggggggtggggggggaaagtccagcagtatgcctctggaatccaaatacttgtctgctacaccgtatataccgccttccccccaaataacttagaagcataagttttcaaacttacagtattgtctgcagaagctgactcccctaacctatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtaggtagaattcctatttttcataatatgtatatcaaaatatgctgtgaattcctttcagattaaagtcatatatgatatatagttgagatggaagtttgtgcgccacatgtattgtgatttttttctcataaatgagcatttaggttggagttcagtgattcacacaagtagtggatttatattatctgctttcaagaacttagttgctggtttttatatatgacttcctgaaccatctgatgcgcctaccatttttatcaagaaaaatcgaaaacacgagttatggactctttggttgtataaactgatttgggcatcacgaattgtatttatgtaaccttcaatgtaaaagcacaagagttagaggatttcctccaaatctgtgaatgtaatatgtcatagatgattctgaatttctgaattttattctggaaggctctgaggctgagccatttgtttttaactggccaggtttttaatgtaaatttatcttacagaaagacaattattataactttaactacactacagctgcttgagagggaaagcccatatgttcattgctgtttctgctttaaaataacagatggtagaaagttacactgtatttcagaagtcaaaggggggtgggggaggaaagtgaagggtttcttggattcttatttacagactttcagtttcctaattatttcaaaaaaattaaaaacaaattttggattcctctccatcctaaccagtaccaaaataaggcattctttttcagctttctcacttaattacttactataaaagtttttttcgctaagcatcatctctgttggtttttgcacttattattctttagtgtgaataaacatgagaataaactttcaaaagaggttttgctaaagatttctaaacagtttcaacagttactgaaagattcactcagctaatttactttgcattgtgggctatcttatgagcaagtagtgtttaaagaattacgatttattttgagatggtatatttatttgaggtgggattgttgactatagtgggcttactaacatcctttagtctcaccctgtgtggggtagctgggtgtgaaagaatggacttcggagcaagggatcagcatttttctttggcttctaccttccagtcagcattgtggccttgaaaactcccttaactccaaatatgagttttattatttgcaaaatgacaggatttatttctaaagtcctttttgtttgcatgatttaataaccttttatgcctattcaattaatgtagaggctgtaccctatgtttctgttcagatcagatttttaacttaagaaagatgcttttaatgtttttggattattgttccctctgagaatatattgacaactgtggactttttttccatataactgctcattcacccaaaatttataaacatttggagtttcagaaagttcatgcacttcctaaaacccatccatatactcacagttaagaactcctgctctagtaaaagtgtagtgataggaatgttggaacttctctctttgatggagttgagagatgatagctcataaatctaaagattatcctttgagaaggaagattgttttgttttcaatgggaagctaacagattttaaacaaaaatgcctcattgcctttggtaagcgaaatccaagagtatttggggaagtatgagaatgggcagcttttaattttgtttcttcttcttggaatccttcaacatatttactttagccaggtcaccactgggtattataggtagttggaaatacttaaatctcatttccagtgcttccgaattcatgaatatgtttccccacccacccccaaggaacttttctgttggttttgctaccagctgatagaacaagtttggaatttcaaatgtgtgaccaactataatttgttacacatttcattatcagctgtgcaaagaaagtgacaccagaaaattaggtgtgggaaatggctgaaaataaatttttgtaattagttttaaataagcattcagacgtattttggtaaaaaggaaatttttctttttcaatgtagtgagataaaaaaataatgcagtaaaaacatttcgtgtccttgatctaatgctttcaaggctaatatcttttagattactgcttttcttaaattgatgaagaaagaggttggtggttatgaaatgagtagttttacagtaatgcatagtgaatatagaaggggagaggacagattgcttagagatgtcttacaggctgtctaatgcagtcttaatcaatgtgtattttgcctattcttaccagtccagtttgtgcaagttaaaaacagaaaccaaaagtaaacatttagaaagcttataatatcgccacgatacccaaatgtgtgatacttttgtgctatgtaaaagtattggtccactaaagattggaaatgtttaaaatatttaaaaagtacacctttgccgtagcttgagaggcactgatctaatcaatgctgcctcctaaatctgggctttctgctctgtcccggggaaaatgtcctattagctctccttcaagacttttagtgattaagagcttcctgtttcacaaggcagcttgctttactggtggacagctctaactactagaaagttctttcttgcatttagatgaaatctgcctgcctgcagtggggagattctcaaccttttcccacttacacacctttcagtaaacacgcagtattctcacacttccttattagagtgtttaagtcaaaattaaatattgggatcaaaaacaagtcaaagtaattatactgttgaatggattttctctaattattctcattgtaaagtaagctaatttttatctgaagtcctgataataatatattgtaatttcttacagtatattacatttaaaaatgtgttctaaatatttagaaagagataatctccaagagtcagcatggattcactaagaaaaggtgatgcctaattaacttggtttttttttttttttgatagatttactggactgtttgttttggagggttcatctttcttttcccttcatttcagcattttagatttaaggctttgtgttaactaatttttttggtaaagagaaaattttgttttatgcattgattttccttgataaatgctgagatccttaaaagtgaagaacgtggcttactcttctttataacttatatggctgacacatcataaactctaaattcgtaagtttttttggtgagtaaatgaataaacaaatggataaaaacaaggcaaacacttggtaggtaaaacagaattggtagtgataactaatacattaaataatttcttagattagattgataggaaacaacctgacactaatcttccatttattcaaaaattatttatttagcacctactatgtgccaggcattgtgctaaatcttaagacaacttcaacaagacaattagatctctgtccccgtgggatcatgcattctaatggaggagcagacaaaaaataagtaaacctatttcaagttgtagcaaggcgataaagggtataatgagccaagatataaaacacaggagagaggcaactttacataggatgactgggaaaacctctgtgaggagatgtacaggatgagaaggagctagctgtgtgaaaagtggtaaacaaagtaaaggggctaatgtgcaaagcctctgagggagtgtgcttaaggacctgaaggaaaactagtgtgataggaatgtaataggcaaatggaaagatagcatgagataaagtggtacccagatttttaaaactaggtatgtattatgataatgaaatactgtaggttctatataagattttaactttgttccaaatgcaaagggaagttactgttaacttttaaacagtagagtgatataattcagtacaccttttaagaagtcatttttctttcatcgtcaatctctatttttgatttttaagtatactttaattgaagtgtaatttatgggcagaaaagtgcacaaatcataactatattcctttttcactttgccagcctttgcactgatggtgtaaaaatattggtgggtaaaactggtggtgtcttaacattagtcaaggcagtgacaccagtctatccatatatatgcatatgggaaaaatgaatcatgtgatgccatatgcaaaattaattcttaatggattataacctgttaaaagaaaaacttcagacaaatttagcagagtttatttgagcaatgaatgattcatgaattgggcagcactcagaaccagaagaggttcagagggcccccttaacagcataagcagcaagcttttataggccagataaagaagcaaagtagataaattacctgattggcttcagctaggcatctgccttgttttgcatgggcatggtatgatgaaacatttaccttgtttgagcatggtgtgatgagttggctgcttgtgatcagctgaaactatctgtttgttatacttctaagttgggtttcagtttgtgtaagtactaagttaggttgtagttcattacgtaggaactaagtacagagacagccccaggctaatggcatcctgcttatttaatttaacaaacctaaatatgaaaggtaaaactaacttccatattaaaaaaaacatagacttaggcaaagatttcctatacatggcataaattaaaggggaaaattttgcctctattcatgaaaaaaactaactggttattttgcctttttttgaaagttgacagatattgttatcaaggcgctctggcctcttaaaagaaattgggcagcattctttactttctgaacgtttgtgtaagattagtcttctttctttcttttttttttttttttgagatagagtcttgctccgttgcccaggctggagtgcagtgttgcgatcttggctcactgcaaactgcgcctcctgggttcacaccattctcctgcctcagcctcctgagtagctggaactacaggcgcccaccaccacacctggctaatttttttgtatttttagtagagatggggtttcactgtgttagccaggatggtctcctgacatcgtgatccacccaccttggcctcccaaagtgagattagtcttatttctaggtatttgtaagagttcacaaatgaagccatctgggcttggagacttctttgtgggaaggtttaaaattacagattcaatttattttattttttttatttctttattttttatttttgagacagaatctcactctgtcacctaggctggagtgcagtggcacgatctctgctcactgcaacctccacctcccgagttcaagtgattctcctgcctcagcctcccgagtagctgggactacaggtgtgtgccaccacgcctggctaatttttgtagattacttagtagagatggtgtttcaccatgttggccaggctggtcacgaactcctgacgtcaggtgttctgcctgccttggcctcccaaagtgctgggattacaggcgtgagccactgcgcctggccaattcaggttatttaaaagatacacatctctttcacatttttcatttctccttaatatcatttttggttagtttttttcttaggaatttgttcatttcacctaaaatttcaggtctattgttacaaatgggttcataatatcttcttattaccttggtaatgtttgtaattgcattgttaagccacatttttattcccaatattagtactttatttgtatcatctcttattaatctgtttataaaataattttttgcatcattgttatttcattccttccactatctttgagtttatttgctgttctttttctaattttttgaaatgaatagtcagatcactggtttcagctgtcattcagttcaaaatactgtaattttcattatgattttttttctttgacctgtgtgttatttgacatgcattccctcattttttaacaatagagggttttgtagttatctctatagtattgattgctagcttaattccatttgggaagagaacatactctgatttcaataatctagcatatggtcaattttgggaaaaatttgtgatcacttgaacagaatgtatattctgcagttactctatgcaatgttctagatatgtgagtaaagtttgttgactgtattgttcagatcttctgcattcttactatttcttgtctgcctactccattatctgttaagataggggtaaaacctcctacagtgattgtggatttgtctgtttcttcatttagatttttttgcttatggtgaaaaggattttggggacaaatgatttaggattgttaaatcttacatatggatttctcccttgttttaaatatctctcatgatttatagtactgctttttgccataaagcctaccttatcgaaaatatgtatagctgtaccacctttcctttggttagtgtttacatggtatatcttttttccatctttttattttcagcctttttgtatctctcttgttggtttgtctcttccaagcagaatgcagtcattttaagtgtgacaattttagacttttaatgtaactattcagtccttttacatttaatgtagtttactggtatttgaatatatacatatacacacacacatgtgtgtgtgtatatatatatataaatgttactttttgttttctatttgactcacctatattcctttttctgaccctttacttttagctggttctgttttttaaaaattttatacttttttctttagtaacttgatagatacatttttttaaaagaccatttattttgggaggcctgggcaggaggattgcttgggctcaggaattcaagaccagcctgggcaacatagcaagaccctttctccagtaaaaatttaaaaaaattagctggacatggtggcacatgccagttgttccagctacttgtgaagctgaggtgggaggattgcttaagcctgggagatggaggctacggtgagctatgatcatgctactgtactccaacataggtgacagagtgagaccctgtctcaaagaaaacaaaactgtttctttagtgactgtccaaagaatacagaatactttcttgacttactacagtctgaaataaaatattactttggccactcctaaagtaatactgggactattaattttttccagttcattgttctttcttctacactgtctaatttcctcttaaactatctattaagctcttaatgtcatttctaaaatttccagttgattcttttttatgaaatccaattctctgtaaaattctctgtaattttacgtatcttttccatcttccctctgttttcttaaatatattacttatagttatttggttttcaggccttctgtttgtatgcaaagtaatttttttgaatgccatacattttgtatgaaagcaacagttttcaaacttttttgtctcagaccgaaaaagactttatatggattctatctgtgagtatttacaataatagaaattaacactgaaaaattgttttctttttatttttctttttctttgttttcattgagacagggtcttgttccattgcccaggctagagtgcagtggtgtgatcacagctcacttcagcctcggcctctcagactcaagcagtcctcttaccctagcctctcaagtacttgggacaataggtgtgtgccaacatacccagctaattttttatttttatctttgtagaaatggactctcactatgttgtccagtctggtccctaactcctggactcaagccgtcctgccaccttggcctctcaaagtgctgggattacaggcatgagccactgtgctggcctaaaactgagaaagtttaaatatatttacctattaattcattttaaaatattaaacttcttatatattagtatagataacataatctttataaaaatatatcttttccacaataaaatttttgaagactaatgagtaaagtgacattgttttacatttttgcacatctcttttaatgtctggcttaacagaaaataccctgatataaatatcaacctctacattcattctgttgtgatatgttgttttgtttaaatgtatgaagaaaatacgacttcacacaaataggtagttgggaaaggaaagagtattttattcatcttttcaaataattgcagatattcttccttgctattaaaccagaactcaacaagtggtagcttcttaaagattagttgcattttggaacctgaaaccatgccaatgaactttcaaggtctattatattaaaatctattggtctatcttttactttgaatttttttttcccatctgtgattttgtaacgtcattcattggtcaaatactgcttcactgagagttacaaatcatccaaatgttgatgtatttcattttatcagtatttctaaagatgtggtccccacactgtcagcagcttcccctgggcaattgttagacatgcagactcttaggttccaccctagacctacttaatcagaaaacctggggttggggcccagcattttgtgtgttacgaagccctccagttgattctaatgtacactaatgtttgagaatcaccgctctaagggttccagctgggtttctggggtgttcagtggggtccctatgcgtggcaggttctgatctctaatcgcagtctccttagcattttgaaacttccaaaaactttactatgcttttcagaagcttcttgcttttttcagaaactttctactttgcttctaccctgtacaagttcagaatttggtatatacttagagggaaaaatcagctgtgtatcaggctctattttcaaacttgcctttttcagttgagttctaaatctttgagtctacaatttttgtcttagcagcttgtgagactgcaagaagccttgcctgcccccagcagcagccttcttgtgtccattgcccatacttctaatttcttgcgttccaccaagaatcatcaaataatctaagggaaaaagcaatttcagaatgtcattttacctctaaatttcctccccttccggaatctttggaccctcaagccatagttttcttagaagtttccctgtaacactaattcaacaggtggggttttttagtggttgtttcatttttgtagtgagttttgactggctttttttagttgcttttagtgtgagcatctaacacactactccatcataaccaaaagcaaaagtacagaaagttacttttgagacagtatgacaaattaattggctagccagtcatccaggaggctggtacagtaatatgagtgagaaataatgatgacctagcttaggagggagacaagaaagtgaatttgagatatgttttagaaacagaagcaacagttactgctgcttgatttgatacaggaaatttagtatttccccttgatttctgagtcaaaaaattaggtagatggtggagctatttactgaaatggggatgatctagagtggacaggtgattgtaaacaggtttaggagaaaagaaatactgtgttgatgttaaatgaattagtcagtagattgtccaagtggaaatagagaataggaattgaataaatgactctagagttcagagaagcagactggacttaagaatcatcaatataagatggtgttgaaaccaaccttaagaggtcatggaaagtgaaagtatggataagaaataggaggaaaaaaccccgaggatccaggtctaaggaaccaaacacttatagatcaagttagaaaaggggaaatcatcaaaggagacagaaggaaaaaaatgtaaggagaaaatgataccatagaagctaagaaaggaatatatttaagggaaccaagtgatcaactgggctgaatgctgctatgagaaccattaaaataaggatagagaggagggtccagagtattttttccacactggaagactttgatgaccttaaaaaacagttttaattggtgcagggctaaggaatgaaaagatgcggaagttgagttagcttatatacacaactattttgagaagttttgtgaggaagaggaggagagaaatggaatattgtctgcaacagagggatgagtcattaagggaaaaatgctgttttttgttttattttgctttttacttttttttttaattataaaagcttgttgagtaatttttagcaggtttgtttgtcagtggaaatgatcgagagaaggtgatttagaagagattaaattttgggggaaataaatgtaatgttttaagtctcaaaagtcaattgtataactgtgggacagagatttggcagtgtttcacatggaaaagagccatgggacatgtatttgatctcaaggcctgtaagattcaacagcataaaagctgctaaaaattttatgcagtcctaagctgcataaaggacacatagtatctttattaaagaccaaatattactgcaatcctctatttatttgttatgcattcattcaattaatatttatccagctgtactgagctaggcatttagatcttatctagaattttgtgtctgtttctggatcccagattttttatggatactgacaaaccaaatagtattcagaggaaattgaacaggatcatgaggtgtctggaaacaatgtcatatgagcaattattcattcaacaaaatttactgagtacttaatgtaagccagataatgcactagatactgaagaagataaccaaagaccttgctgttaggaatcttatattccactgtgagagacaatagtagataggtaattggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaaaggctgatataaaaaatgcccatgatgtcatggatcataagtgctttgaagaaaaagcagagcatgaggtagagaatggcagctggaggggaggcggatgctgatttacttatagccttcttagaaattctctctaaggagataatatttgagcagagacctaaggcagtaagtcatgcaaaatgaagaaagaatatttcaggctgaagaaacaccaagtgcataggtcctgaaacgagaacatatggtttgtttctggaattataagcagatcagctggagcataggaagcaaaagggagagtggtaggaaatacaattggagaggaagcccaaggctaaatgatagagtggcttgcaagccatactacaaacttcaggttttactgttgggcattatgggaatgctattacctgttatgcagtattaggaagactattttggcagctatgaagcaaatagggagtcaagagtggaagcaaggcagtcactagagaaaactgtagtaatccaagagaatgatactgttttggatgagggttgttgtagtagaggaggtaaaggggaaaaaaaaaggtctaggcccggtacggtggctcattcctgtaatcccagcactttgggaggctgaggcggggagatcacctgaggtcgggagttcgagaccagcctgaccaacatggagaaaccccatctctattaaaaatacaaaattagccgggcgtggtggcacatgcctgtaatcccagctactcaggaggctgaggcaggagaatcacttgaacccgggaggcagaggttgcggtgagccaagatctagccattgcactctagcctgggcaacaagagcaaaactccatctcaaaaaaagaaaggtctaattcaaaatatattttgaaggaacacccaacaaagcttatgaatcaggggtaagaaaaaatgaggaaagatcactcctgggtttttggccaaagcagtggttagagaaaaagaaaatttgctatactgagaaacttagaggggatctatgcaatatcaaatacttaaaatgtggcatgtatatgtgaagtccctcttgtatgcctctatgaggacagaattatgttcactgagaagaaactctaagcagtgaaaatttgacccctataaggaagacttttcttctagctggaacgtaagacatcagtcagctagtaattattgaggctttctggaagttggtagaacagggtactttctaggcactgaagctacagcagtggaaaaagtgatgtgcagatagaggcagcaaaggtaatttgattgaaaactactagagagcaacttattagggatgtcatagaaggaatatatttattgggtaagaggtagaacctcttcagacccttccaactctgggtttctgtgattctctaatgatctgataaaccgaatcagactcaaatatttttcttcagatccccttgtctctacattatttaatgctatattgagataccataccatacaattcaattcatccatttaaggtatacagttcagtagttctggtatattctcagacatgtgcaaacatcgcactcaattttggaacattttgatcacctcaggaagaaacccctttagctattgtcccctcatcttcctgttctcagttcagtttcattgatcagtctgtctgtccttgtcctagtaccacactgtcttgattactgttgctttgtagtaagttttaatattgtgaaatgtgagtcctcctactttattcttattttgtagaattgttttggctattatggtccttccataataattccatatgaattttagaaccagcttgtcaatttctacaaggaaatcagctgagatttttgataaggattgcattaaatctgtaaattagaatggggaattttgccattttaacagtgttaagtcttctgatccacagagacatgatgtttttctatttatttagatcttccttaatttctttcaacagtgttttgtagtttacaagtctgagttttggacttcttttgttaagtttattcctattttattctttttaatgctattgtgaatggaattattttataattttattttcaggttgtttattataaatgtatagaaatacaattaagttgtatattgatcttttatcccacaaccttgctgaacttatttattaggtctaatagttattggtggattctttaggattttcagtatacaagatcatgtcacctatgaatagtgatagtcttacttcttgctttccaatctggatgtctttttcttttttaacctcattagactggcttgaacctccattacaatgttgactaggtttattaagaacagacatccttgtcttgcttctgatcttagggaaaagcatccagtcttcgctcattcaatctgtgggttttttgtagatgctttttatctacaaacatactaacacttagagaacgtctgtctattcctagtttgctaggtgcttttttcctgaaagtgtgttgaatcttgtcaaatgctttttctccatgtattgagatcattatgtgaatttttttttcttttgatgagactcgatatatttattttttggtggttaaaccaaacttgcatccctgtgttaaatcccacagggatttgcaaggtttataattcctgcatcccttggttggttgtggtttataattctttttatatgtttatatattctttttatatgttgctgggtttggtttgctagtattgtgttttagtatctttgcatccacacttataagatatattgatcagtagctttcttatgatatctttgtctggttttggtgtgaagataatataatgtaggctttataaaataaattaggaaatgttctctttctctcttctataagccatcaggggctgggcttttctttgtgggtagttttttgtttactgattcagtctcttgttgcaggaatattcaagttgtctcttcttgagtcagtatcagtagtttgtatcttttaggagcttgtccattttctctaaattatctaatttattgacatacagttgtttctcttctttttccattgtcttaggttgaaggttaagttattgaagtcttttttttttttttttttttgaaacagggtctcactctgtcacccagactggagtgcagtggcacagtcatagctcactgcagccttgacctcctgggcttaagtgatccttccaccttagcctcctgagtagctgggactataggcacatgccaccttgctcagctaatttttttattttttgtagagatagggttttgccctgtttctgaggctggtggtctcaaattcctgagattaagtgatccgtgcccccctcaccctcccaaagtgctgggattacaagtgtgacccactgtgcccagccgtcttcttttttaacatagacatttatagcaataaatttctctgcactgctatcgctgtgtcccataagctgtgggtggtgttattcatgtttaatacattctattattgtcggagaatacagtgtattatttctgtccttttcaacttattaaggtttgttttgtggcctattatatgctctgtcctggagaatgtcctctgtgcatttgagaaaaattgcgtattccattattgggtagtgttctgtaaatatgtgttagttcttgttagtttatagtattaagtcttctgtttccttgttggtcttttgtgtggttgttctgttattgaaagtggggtattagctggtatttattcttcatttcttagtttctgtttttgttttggttggtttttgcttcatatattttggtgctctattgttaggtgcacatatgtttacagttgtcccatcttccaggttgattggcccgtttttcattatggaatgcccctttttgtctctaataacatttttggtttcaaagtttactttgtctcattagccactctagcttttcagtgatttgctgctgtcaggatatgtctttttccatccttttacttttcagtatttttgtcttcaaatctaaagtgtgtctcctgtagagaacatatagttggctcatgcttgtttgcttttcttcaatttttaatagaaacagggtcttgctatattgctcaggctagcctcaaactcctgggctcaagtgatcctcctgccccagcctcccagagtgctgggattataggcattgagccactgtacctggctgggtcatgttgtaatttaatccggtgcgacagcctttgccttttgattggattgtttaatcctttctcatttagtgttatgatttattatttacttttatttcagtagttttgggggaacaagtggtgtttggttgcatggaaaagcttttttgtggtgatttctgagattttggtgcactcatcacccaagcagtgtacactgtacctaatgtgtagtctttcgtccctcatctcccttttctttcttccccctaagtctccaaagtccattatatcattcttatgcccttgtgtcctccaaagtccattatatcattcttatgccctttcacttataagtgagaatatacaatgattggttttccattccggagttactttgcatagaataatggtctccaattccatccagatagttgcaaatgccattattttatttctttttatggctgagtagtattccattatagatatgtaccatgttttctttatcctcatgttggttgatgggcatttaagctggttccatatttttacaattgtgaattgtgctgctataaacatgtgtgcaagtgtctttttcacataatgacttcttttcctgtggaaagatacctagtagtgggattgctgaatcaaatggcaggtcttttagttctttaaggaatctacatactattttccgtagtggttatactagttatactcacaccagcagtgtatcagtgttcccttttcaccacatccatgccaacatttataattttttttgattttttaattatggccatttttggaggagtaagatggtatggcattctggttttgatttgcatttccctgataattagtgatattgagcatttttttaatgtttgttggccatttgtgtatcttcttttgagaattgtcttttcatgtccttagcccactttttgatgggattatttatttttttcttgctgattggtttgagtttcttgtagattctgtatattagccctttgtcagatacacagtttgtgagattttctcctactctgtgggttgtctgtttattctgctgattatttcttttgctatgcagaagcttgactgaaagcttttattatgaatgtgtgttgaattttctgaacttattgacatgattatgtatttattttggctgggcgtggtgattcacgcctgtaatcccagcactttggggggaggaggctgcagtgagccaagatctagccattgcactgcagcctgggcaacaagagagaaactccgtctcaaaaaataaattaataaatatatatttattttttattaatgtggtaaattacatcgattaatttttgaatgtgtaagccagtcttgcattcctgagataaacctaacttggtcatcatatctagtctgatttgataagtgagtattttgtttgttttgcacctgtgctcatgagagatctgggtctgtggtttccttgtgacattttcattagggtttgttatcaaagatatgccagcctcataaaaagagtttaaagtgttttctttctcttctgtttttcggaaaaattcaacaaaatcatggccaggatttttatttatgggaaggtttttaattacatatttagtttcttaaatattcttttgattttccatttcttcttatattaattttgaaatgttttctttttcttggaatttatcttttacatttttatgtgctctgacatgaagttgattagttttttagagaactaatctttccctgtgttgattctctctcgaatgctaatttctattgtgatatcttccttgacgcatgagttatttaggagtatattgattaatattctaacattgggatcttctatatgtgtttaattctactatggtcagctaacagactccgtttcaatgtttctgaaactctgtgttggaggactttgtttttttctctcaatctctggtgaactgacagcttttgtaaaatacaatgaaaatgaaattatgagaaaattgaagaaaaaagtatgtatataagatccaggttttacaggggtacactgttatttcaaacaggtatattttctaaacacttaatctcaatttccaaacctatctatggtctaatagcagttgtaagtcaacattcatccatggaacacactttaaatagcaccgtttattgttattttaatctttgaagtttgtcgagacttgcttttagcctagcacatgatcagttacagtaaatgttccatgtgcagtttaaaagaagatatgttctgcacttgcagggtggaatcttgtatgtgtgtcagttaaatcaagtttgttgatgttatttaacttcagtgttcttactctttcattttgtctacttgttttatgcattattgagaagaggcatcactcactaaaattgtagatttgtgggtttttccttttggttctctccttttttcctttgtatattttgaggctatcttattaggtatattcagatttacaattgctttctcttaccagtagactgacccttgtaacactgtgaaattggctgttttatttttgcattttaccttaaaatgtactttatctaataattagtataacaatgtcagcgttatttttgatagtgtatatttttttctatttcttaaaagtatagtctcttataacaatatataacctgctggatttttattaatcaactttattgagatataatttatatagaataaaatgcacccatttaaacgcacaatttgacaagttctggcaaatatatatgtgcatgtaatcactaacagtcaagacatacaccatttccataagctccaaaggttcctttttgccccttcccattgccaatccctccccacagcctgggcaatcaccattcttctttctgccacagactatagattaaacatgtcttttctagagtttcatatatatctggaatagtattatatactcttctgtgtctggcttctttgaaggaaaaaagcagtgcagaatgttgggctcatcatagtgcatttccgttatctccaggatcttggccctcaagacctgactgacttggtagccctccagtgcttttatactgatgtgtttatattttatttagctcttctagttgggtgtcagtgggagagttggccttaaacatgatggttcacaatagccagaagcagaagacttctggccatatttagtggtagaagtacaaagatacagaaatactaagggtgaaggtgagtgttctaattaaatggaacccactgaattcccctagaaaactgagaggggttgaagagtgttattttttttgttctttttcttttcttttcttttctttttttttttttggagatagggccccaccctgtcgtccaggctggagtgcagtggtgcgatcaagactcactgcagcctcaacctcctgggctcaagtgatcctccacctcagcctctccagtagttcagactacaggtgtgcaccaccacacccaactaattttttaattttttgtagagacagagtcttattatgttgcccaggctggtctcagactcctgggctcaagtgatcctctcacctcaccctcccaaagtgctgggattacaggcgtgagccactgtgtccagccaagagtattttgttttcattaaatttagggtatgcatcctatcctatgttatcagtcaggattcactgccagcaactagatattataaccaggagagcatttagtacaggttacatattgttggaagatctgaaggagcaagttctacacttggcctacaagaatcattcctaaacaattacagagctactctgtcagggaagctgctgcctcacaggctgccactagaactgtgggagaagcacagttgctgccaccactataccacactcttgcttactagtagtaataatgataaagaggtgcagcaagaaagcctttctctcatttcagccttccaagtcccacaagaatggctctaattaatggaacctaatgtgaatcaaacactacttgaagagactataagaattgtagttttggactgaggaacttttccaactatttagaggtagaatgagggtcaaaagaaccagtccaaaatgtctaccatgtacataaattaaaagccctctaacttagagtgagtggtagagaattcaacgttattctgaataaattgtcatgtcatttttttcctctaacattgctatcaataagtataatatttaataagactctctatcatctgtgcctttgattttttccaactgctgagtgagcatagtatggcctatgatttaaatatccataatgcatatcaattaaaggttatgtttaagttcagttaatattttaatatttgctgaggatatccaagacatcgaggacatcaccctgataactctaagaatttaaacagcttaccacattgacattacctaattcctgattgctagattgtcttcaaagataatcatgaaatcaacatatttcataaccaagtgctttaaacttttatcagctttctttgtaactcttatagcatattcagggacatactatgatatattccataagtgtttatagcaattcagatcttgatatgaaaatgtcagttgtatcctcaagggcaaagaggtaaatatagctttctccagcattaccccttctaccacaacaccatgtttgttgatctattttctttgctttcttttcccttcataagctgggtggtatggtatcaataaaaggccagaaaaaagtcagaacaatttacaccaatactagctagatgctttttggtttgttgtaagctactgagaccttatgatattttcagcagctatagatggtttgcacttaaggggagaatacaaaataaaaaacacaaagagactggtgagctgtaatatgattgttagtctaagcattaaacaatgacagtattgaggactagaagttagaaggtatatgatgtttagctttcatgtgacagtttggtgctagtatttttgtatgtaggttctgtttgtgatttacaatgattctgcatttgaaattcacctcaattttcctcttgctgtttgcattagaaagaattcattgcaaagaactctaaaaaagaactgacttaattttattttttgcactgtaaatccaaaactacactctgtaaatattcgaatagaatcatttcagagaacaaaaaaaattttttgacattatttttatctctcatttattaagattagatcatttatctctattaagtaaataggtttttggcactgggtagtatatagttgcctttttaaacatacattttatttttgtgacattataagacttgattaatactttaaaagaccccttggattgatttaccttcttcaaaaagatacccgttttcacagatgaatgtgtctttaaaaaaaaaaaaacagtcatggaaaagactgttattttacttgcctaaccatccacttaattttagaaaattctctggtcaaatacttgaaaggtgaatgtctgaccagtgcagtagttgaatgttgttcaagttattcctgattataactttctttcatcatttttctcagaggtttttttttattgttgggtagttgtaggacttcactaatcaagtttaatttatactgttttgatttctagttagcttataaaataatttgtcagaggattaatgtgtgagacaatattcaaaaaagagtatttttatattttggggactttaaagtatgtcaatgatgaaatgtattttaattcatttttctttgttctctcaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaataaattcccatagcactttattcttcacatggtacataactataggggctatagcttggtaccttgtgaagcaactcttggtgtaacataccttatttctcatactaaaatgcaagaacctttagagcaaggatcttgccattcatctttgtaacctctttactctggagcacttgcatttagcaggcatcataaagttttacgtaccaagaaaatgttgctgttttctgaatactatgcatcaaaaaatgttaccactaatttttaaagctctgctaaggaatattggggcaccctcagatgcaccttttaattgatgtcatattttcctaatccatactttattcatgagaatttgagtcaccccagcattagcttggaatttccttatttcccatttgctttgcaggtgccttggagtcagatctggttttgaatactatcttcctgttatgtgatcttgggcagttacttaattttctagtcaataacccgtatctataaaatagagaaaataatcctacacaccggggcctgttgtggggcggggagaggggggagggatcgcatttggagatatactaatgtaaatgacaagttaattggtgcagcacaccaacatggctcatgtctacatatgtaacaaacctgcacgttgtgcacatgtgccctagaacttaaagtataataaaaagaaattttaaaaaatcctgtcaaataaggttatagtagagaataaggatgtgtaaagcatttagtcacgtaaatgcttaaaaaaatgtaatttttacttctttcactgcctcatttaattagttttatctttaataataccttggattcagggtaaagtttcagttatgtcccagtaatcatttattttaccctcgaatctgcaatttggatagaacatggtggggacagctcgtctctattccttgcagcattaacaggctggaggcaccacttctctggccagcaagttgggcctggttgttggctgagagcctcagttcctttctgcacaggttcctctttacataggcttctcaacagggctactagagcatcgtcaccatagcagctgtcttataacagagagtggtcggtctgagagacaaaaaatggaagctgccaaattgttctgggtctggaaactgtcagggcatcacttgtgccatattcagttggcctaagaattacagagcctgcctcgattcaaagggagaggatagagaggactgaaggaatcagtgctcatctttaatatgcagcaggacaggtttgggattttttttcccccttgagtctgtgaaggcattacttaagaacaaagtcaggcatgtataattgaactacagttacttgaaatataagcccagaaagtttcagataataaatacaactatttttctgctgttacccttgtacctaaagatgccatcctaatccccagatctccacaactatacctacatagtagaaggttaaaatgtatccctctttttctggtgcatccagcaaaagtaatatcatgaattatgagctctctgagagcaaggatcatatcagtcttgtttattgttgcagtgaacaagtacagttgcagatattcaggagtaattatctaaatggcagtaggcttataaaactgaattttcaccagccacaccctccccccaactccttatctgtaaaaagcttatttgagtggttacctgtcttcagtaaagattgcgcttgcatatttgctgtcattgcatattctgcttaattaagctctgttgatattgcagtttctgtgcatacttacatcttagatgcaatctgagggcctaggaaggccttttaaaaataaaacaattccgattgcagagaaagtgtaagtcaaggacagttaattcaaggggaacatagaaagctatttagattttagttgatggtgccagtcttcagcgtaaagtcaaaagtggagggaagtttagtaaggaaaaaatgttgggcttggaatacattgtttagtcttcaaagcactttactttttatgaaatatattttagacattcagcaaatattgaatacttactatatcaggcagtaaagatataaattcattcttaaaatgtgcaacatgttcaaactgaaaaaaatacattcttaaacaggaaactttttccttcatactttttaattaacaagacatataagagttgcattaatgggcgtgcttatgattgatcacccagcagcatcattagaaataatatattttattcatgtgcagaaatcttttggttgtcctggggaaccttgaacacagaaaagagcttttattgataaggtaattgaacacacttgacaattagcttaatatggtttaataccatttgtgggagaagatgaatcagccaggctctttacgtcaagaatatgaagtttctcttgagtcaaccaacttaagatgagctacggagactgcagtgaaaagttaaatatccaagtacaccagccaatttcacacagtggaaccatgctgtcctcgggcaccctgcacctcgcccaacagtcatcaactagatggaggctcctggctgcaaggaggatttgatgggaatgagtaaatgtgtcagcatagtccgtcccttctaatggaaaagcaacccaaagagcaaatcctattaatggctggatcagtatcatctacttgtcaaaaacattccatgaattatgagtcaaaattttatttatggtggcattacacacattaagagatgaggacttctgttagcataatttattagctggaaaagttgagaaggttctctggactcatttttataggtggaacctaagtgatctggataattgcccaccagcaaaattgctgggcatggtggacaaagaaaatgttccttctaatgattttttatgagctgagtagctattgttcccagctgagtgctcttttcctctttttattgttgctgagcaaaagaatttataaaaagctctttcttttgtattaaaaaccctgctcaattgaaatgcaagttcattaagtaatcttcatttctcttcctgccataataaccctttccctctctgttcgattcaacagtatctagcagcactgctccaaattttaagtctgaacagactatattacatagatgtagagaaatactcaatcttcagcattaagagggagcttaatttcacacgggtggaatatgatcactcaggctagatgttggccataaatttcaaattagtatctcaacttagcaggggggatcaacagtggcaaacttcaattatgacaggataaaaatcacatagagatattggttcaatatggacatctaaactataatgctaaaagccaataattagaataagttcattttaagaaaagcattaataatattagctaacgtttagtacctgtgccaaacattctacctatgttaccttgattttcatagccagcctaagaggtactattatgtatccccattttacaggttaagaaacaggctcagaggagtttaggatcttttccaagattacatagccagtaagtggtggcactaggaaccaaattcagactctgaatcgcatgctgtttatattatattgcactcattctaaatatgtgggaatcagaatgaaggggcttgtatgacttttggctcattttttgatgcatgtgacctgggattataaatgtgaaattaggtttacgaaaggatccagtgtcattgtgcatcatgggcaaggagtacctaatctctttaattcttccctggaagcttacgatgtccatccaagtgcacatagcaaaagttctgttgtaaagtttagcagagtgactttctttgactcagagtgatgacggaggaagctttgataagattttatctgaaatgttcatggacaagagctttcaaggagaacatccagagcaaggttctgaagacagctcatgaaggtgaagcagcagacctggcacaagaaatgaagagagagctcagtgtattaaagatgaaaacaagaaaaccgaatatattgaaaggagcagagaggcaatgaaaacaagacaactgaaatgaggtaacttgcagcaattgaaagggaatttcagtacttttatagaattcttaaaaattgtttcctgctgtttattttcaattttgaacagggttatttgtccatgccatactttttttgccaaattccaaaattgtgtatagttctatagttgtctggtggagtcaatggaactttagttaccagtctaagaatgtgtctttgagattgtccagttaattctctatttccagtagctgtaataaatggtgaaaaggtttctgactcctggagaaagtttctaactccttatgactaatattcataacagacttgtgagttccttgaacatggatacacctatatgcaagagtgtattccaaagctaactcagtgatctttccatttatctattcttggattagtggtgcctttgctctttccttctgtaaatgtgaatagttaagagttgactgcagaagtgtttacactttggcttccatgcctctggaatgtttgtgctttggtggtgagatgtgagactatatttgtatagtctgcatctctcaggctgccccagaatgttgtacagtgcagtgctgaagaaagcagcaggtacacacagaaatgcagcctttcctggttaaccctgcttggatctgagttacactttgtttcctgacttcttgggacttaggtaatcagtttgccttctactctatctcattttgtactcgcttacatactacattcttgtttgggctttcgtttcttcttgtaagcagagattttttaaaatccaatatgtgaaaatacggatgcactacaattaaataaataaaatgctgttgtgtttgttttgctttaaaattgtaaaggataaacaataagatagttttatctatgtggttttcccgatgcagttaaaataaaacctaatctgctaaaattgaatttacactcaatttttctgttgtataattcttgaagaacacctcatgtgttgtacaacttcatctacattgtgaactcttttatttattgaaagtctatcttagtctttcactttttctacacttccctttacttcctcatgagatgctcagcccagttgtccctcaggacacagtatcgattggttcacttttaaaagcaactgttagaaacccaaatcatagacatgtgaattttctcagaagccattattgaaacttggatttttacctctcataccaaaataaagaagggaaaaaatagaaatcagcccaacaatacttttaaattgatttttatatttatgttgtaatgcaaataccaaagaaaagtgcctagttccttggtttatttacttatatcttgcctctgttatcttcatatcaatttttggccttagcacttttgactgcataaagaactctaaacataggcaatggtaatagaaatgctgacacatctgaactgtcaggcccagaatatattattgaatatgactgcacaaatgcctggaacctatacttagcgtaaagaataaggctgctgttttcaacttccaacaggaggagagtacagacatatgtgccctctgtttcccctctctggctctttcattgtctttcccctatgtgtgcatgcaggcaggcacacatacaaacacatcctgccccatgaagtggtcacatcttaatatctactaaggccagttagacattctgtgggccgagtgtatgttgcagttgcttaactggcctaaaggtctcatgatatcatgggcactatcgagtgatgtttccaaatctgtagaaggaggaggactggtagtgttgggcttgcataacataaagggcctgtctaccataaaacaggagcttggatttgtttttttcaggagatgaatatgtttttcacagcagtctagtgaattaagaacaatacacagaatcccacagcgagcgtgttctatttgaatctgttgatgggatttatgtatggaacaacaattttctgtatagacataattgaatacatattaccatgatctgaaaccatgcaagaatatgtatggtgtgtgggaaacctgaagacagatacaactgatgaaattattagtttacattttttattcaaaatatttgtgaagcagctattccctacatatgctctatgtagaaatgcagagacaagtagatgattataatgtgtcaccatctcttttttggactgattttttttttttaaagacggagttttgctcttgttgaccaggctggagggcaatggcacagtcttggctcaccgcaaccaccgcctcctgggttcaagcgattctcctgcctcagcctctcgagtagctgggattacatggactgaatttttaatagagcaggaatgccaaaagggaagtccctcagatctggtgtgtggctcaataatgcgctcagttccatgcagcttcttcccttagggctctgagtaaagtctctggtgccagaaggtatgagggtctcttgtatttaataatatcaagggagtacagtgttttccctcaaagcctggccagcagttactcctggagaaagaagaacaatctggttgacaaatgtgtcacccatgtaaactcaccagaaatatctagagccatgaacacctagtggggtcagcaataggtcaggcagtaattgctcagtgcctcgttcgctagcagcagtgggaactgctgtagtgtaaattggttttaggggccaaattgatcaaccaaaagaggcttagagatttttggtgtttgagttactgacgagggttccaactttctggatcacgtgatgaaatgcatggcagttgactctgctatcctctaggttttgtgtctcccttccaacccccatcagcaaccgtttcttgttcttgaggctgcttagcctaagaacttttggtctttgctgtctgggagttacaaatccacaatggcagtgaaagcttttctttctccctcatcctttgtcctttcctacttttggcctttttttgcttttgcaccagttacacttgtgtccatctgctagacacccacagcatcagggtgcttgggcgtggttcctgctgggcagttgaggagctctgggtccacgacccagctctccaagccgcctcaccttgctttccccttctgaaataccactcacctacctgcccacagagggagacagtgagactaacgagaagggcatagggagtaatgagaagaaatgcacagcgtgttctggactcctcgaagagaagtgtttgttcaaggcattattaatatttttgcaaggcacagtaacattgattttttcatccaagaaccatttcgcatttgcacagagtagtcactagagtgttgaaccattttcttttatacatggaggaagtggctcatcctcggcctaagagcaccaaatttgagttggcattttttatttccagttccaggcatgaatctttgctccattttgcaggtagctggaaaatcttctgtttgtttaaatccacgttgggtaatactgcatcattttaagttttctatctggagcccggtacaggaattcaccaatgccaagcacggactctgtgcatagatgccttgtataggctccaagctgcaagcctcccacactgatggatttaaatttttattttacatcccagccaatcaggtgtctgactataacttgaagccaattagtatttttcacagagccaggtgcaaagctgccaggtaacatctgcaagtgacttgcattgctctaatgggatctgcatatgttcagctctgtatgaagatgtttttcacttgacatgaagtcatctttggtcttgttctccctcgactccattaagcagacacacctacgtgtgtggccaatttgatccactttcaaaggaggatggtgcctagtgtttcttttcatgatctattatttatgctgatgcctcttggaaaactgtatctacccatccaaagtgctttgagaggggaggggaaggggtgtggcaacacatctctcagttactatcaaggcattttctgataatacgtggcccaacctaaattatccaataaagatttacttgaggactttgtaaatttcttttaaaaaatatatctgatggaggcaatttttttctcaaagaacatacctgagttcctttaactttgaggaacaaagacgtgggttctagtctcctagtttgcagctgatgagctatgtggctctaggcaggacagcctttgctgagccacttgcataggtgctcactgatggccataggacctgtagaaggagcacacctttccgagtcacactgacctcagtttgaatccctgaccctctctgttggcacagtcatcttgtggaagttttgtgacctctcttttggtttcctgacccatgaaatgggtataataatacatacctcagagggttatttggagagtttaatgctttcatatagacatgcctgcttagtgcctgtacatgatagcttttcaaaaactgctcatcttcacagcctgtcttttttactccactgcttttattttatttcaagtactatacaaatattccaagtggatttttaaaagaatggataactaccagtatttccaacatcctaacctcaactatattctttttttctggggtctcttctagtacatattcacataaagccttaggaattgatcttataggaaatgcctgtaggcaaatatgctcatctctagactggaaattgaaccaaagtattttacaacgacactgtggctaaataagaaaacgtgtttaacagctgaaaacgtcatccaagagcatttagaggaaaaaagaaacagtcctttggccaggattatggcaaagcaaggtatgataatattaacggctgttaattactaagtgcctgatatttgtgccaaacattctttatattatttctttcatccttatagcacccacttagctatgcatctcttttcaaataatgttttcaaatgcataacaaaaaaaaatttcacaggaaaccaattagtttaaaacaacattttttataaaattgaaaaacatttgtgatatagtaacgtatgtgcctcattattaatgcattaaatttcaagatttatttcacaaagaaggggttcaagagcataagtacttttcatagaaccacatggtcaggaaggcttctgctcccaggtcttctacctgcatagtctgtcctcttacccccttatcctgctgcctgaagacacttagggagcttaagactcttagcctaagttcctgaaaacttctctcctggcttaaagtgaatgctgggtaatttatttagtctgctcggggtagtcattcattccaacatgattgtagtccaaggacctcccttcctttcagaacatttgtcacttgtcatgttgcatttaggacgccagaggaggcatccagtgaaatgaacaggaggcacttttgtgacaaatagacttcggaagccaaagctggaactggaaaagaccttgcagatcttcaatcctccttaaggtgcagcctgatggatttccagatccgtgacattttttaaacacttgatcacagcaaaaagaataaacactgatttaaaaggaagacgccgggcctaggtgtaagagagaatgttgccatttttatgtcatcttcacagggaaatagcagatttcatgaactcagactttggagaaaggctaatgtggatttaaattccaggtcatatacttacttgtgtggctttggacaatttactgtaaaatggaggtatatcacctacttcacaggattactgtgagaatgaaataaaagtgatgcgtgtaacacattgacacttggctggcgctccgtaaatgtgtgcacaatacaattcctttcactaaaccagtgatcctctgctttgcctgtttcttagaatcccctgtgtaccttttacaagttctaatgcccagacagcaccccggaccatcagactttttggggtgggagccacgcaacagtatttctccatatccagccaacgttgagcatccctggactagatgcaggctgagtgaggcccaggcacagagggcagcctgtctgcaagggctctgcaggaacacagctcaggacggcagcaggggtcagggcctggggcagtgtggacctctcagctcactccaagagctgcaggcaggaccatccccagggcgtaactgagggcaaatcactctgagggcttttcttctgccacagcacttttatacaagcgaaacagaaaaaaagggcagcctggagaaagattatgatcaaagcaggcagcttaaagagtgatggtaaggaaaggggaaaggagacagccaaacggggtggtgagaaccagcctgcacccgcacatctgactgtgaaggctctctgactttcagtgcaactgtccaaagtgatcgtctctttcacccgctcagaagtcaaggactgggagactcattattttgaatagagtttccccgaatcattattgggaagttcaagtgtggtcccaggatcagcagtgcagcatcatcggagagctggtcagaaatgcagaatctcagaccctgccacagacctgctgagtcagaatctcgagtggtggagcctaggaatacgcattttaacaaattcacaagtgagcatgattgagaagcactgctgtgtatagtgaaaatagagcaaactttaggggcaaacagcacttttgagtttgagccctggctctttcacttactgtgtgatctttgaaaggttgcttaactcctctgaactcgtgtttcctcatttgtaaattggggatacaaagatttaccttaataatggagtccaaggaaattgtgaatgaaatagaggggggtctttggacttggattggaaaaaaaatcatttttgtttttcacaaatttctaactaaaatttagcattttcttttattatgaatgtcagcaacatttgttagcagcctgtgactttgtcaccagaacaagccacacatatttctttttctatttctttcttttttttttttgagacagagtctcgctctgtcgcccaggctggagtgcagcggcacaatttcggctcactgcaagctctgcctcccgggttcacgccattctcctgcctcagcctcccgagtagctgggactacaggtgcccgccaccacgcctggctaattttttgtatttttagtagagacggggtttcactgtgttagccaggatggtctcgatctcctgaccttgtgattcgcccacctcagcctcccaaagtgctgggattacaggcgtgagccactgcgcccctatattacattacagttgttacagataactccaaatatcatttgtattcatccagttcaaaattacagttgcttttaaacttgccgctagatatttaatgcattagtaatgaggcacatacaccatgatatcacaaatgttttttaattttataaaaactgcattttgaattaattggtttcctttataattttttttatacgcagttgaaaacattatttgacgagaggtccatagactcatggcacaaaacactttcaaaagccctccctgcctggaaagttgttgtgatgatttagtgatggaatcaaatgtgtccagcactttttagtgattcaaataacagtgccctgattgtcctccccaacattgtcacgtcttgctttgtgctaagcctgggccaaagattctctagactttcctgggggtgtgtgagaatacacactgtctggtcaactttccctgcaggcatttctctggctaatcctggttttatggaatgagagctgttgtgtgttgagtgcctgctctttgccagattggtgaagtatgctgccttgaatcacatggccagttaagtgggaaagcaggtgggtggtctccatgctgccatgtatattcctgggtggagctaagtccagatgttggcggacagactaaggactcctgcatcctcctagttcaagaagatgacagaagggctatcagtgaaatcactaagcacctacaatctcttagttcttgtacattcaataagcattaattaagcacttactatgtgcctggccctatgctagtcactgggatacgcagctggataggccgtgagccttggctctaagaagactctatgggccctgggagcagagaagggtatcccctaaaccagtggggcagaggtggggactgaaacaaggttcccctgagcaggtggttaatttgtcaaattggctgggcactgtaatgccccggtgtttggtcaaacattattctggatgtttctgtggggtgtttttggatgagattaacattctaatgggaggactttaagtaaagcagattgcccgccataatgtgggtgggccttatccagtcagtcaaagactttcataggacaaatactgacctcctccaagcaagaaggaattctgccagcagacagccttccgacttcagctgcagcgtgacttcttccctgggtctccagcctggtgacccacctggcagattttcaactttccagcctctataacctcctgagcaaatctcttaaaatggatctccccttctatctgcacctcccattgattctgtttctctggagtgccctaatacaaagtccaactggctatattcatttgtgattatgctcctatgtgctttactttttatttgattatgtctcattacacagttcctgtcctggggttctgggcccctgagggattttcattttattacatagaccccttgtgacaatggtgtatctgggctaatgtaaccagtgctgtttcactgggcacaaactatttggggtgcactgggaagcatacatgtaggagggaaaaggaaagacatttattagtgcccactgagtgccaggccctgtgcattttacactaatttcaacctctaatactcggtatacaacaaggtacacagaattattcccattgcacagacaaagaaactgaggtctggaaagggtaagtgacttgtctgagcacaccctgctaataagaagaatcaaagatggcacccaaatctcaggatctgcctgacacccaagacacccgaggccaggctctttaaaacataaaatgctgtttcacacaaaaggtgccaggccaagggaagaggagccccttctcaggacagttgtggttccatagtccattaaaccttcccaccaccaaggggccctgcagccaccccaccccctcccatgagagatcctctgcaccttgcttgaagctcatcaggaaggtcaccaaattgtaaaacaaaggaatccttcagtctcaggaggatctttgaaacaccgcacctcaatccttggccccagagcctaggatccacccagggctccagggcctcaggcatttggcccatcaagtgctgcttgactcctctgtatctcaccccattgtgaccctggcattttgctcagctgatgaggatatcatgtcgggcagcattgcagctcttgtgcagcccgggagattgcatctattgttgtttccttatctgtgtgctctttcattctatcagacaaggaaattaaattggtctggcaccatttgctctctagaaagctactttggctgctaaatccaccaaagggggtggatttatttgggtgtttctttcctaagtgagtgaacaggccttttcagagccgcccacaattaactgaaaggcccgagctgctgtgccaggcccacctgttgtggggatggaagccaaatggggcagatgggatcgaagcggggccagaaaaatagcctcttaatttagcaccagagtcctctcccactctgctccagcccccctacaactggaaaaatgtggaaggcacaaatatgagtcagagaaaaccatccaggaacctgggtgttaaaaccccacctccagactgcagcagggaacgttaggaaaaaagggctgaaaaccgaacatcaatattggttttgctcctgatgcctggaagggtctcccttgccttgtcctcttcatgaatgagcattcacctcttcatcctccaaagggggccctcgcagttttccgcagcctccgcgtccccatgtccccaggcagagagcccactggcccttttgcatctccggcatgttgaaatgacctgttggcatacttacgggctgatattattatggttttttttttttttttttgatttgccccaaaaaggagttgaggtggattacaaacttataactgaactttaaaataaatcactcacttgaaagttggtggcaactttcaagatcagggcaaaaggaaataagaaaaatttatgtaaaatatttactctggggtcttcttggtgggccatggctttggccctcagctttccagcagccaacccgaagctggtgcgtatcagttccttgattcacgctgttcacagctggtcaggtaaggcacggcttttccagttctgaggcctaagaggaactttgctcatagtttctcataaaaaggaccctgtgaggggtcatgaacagtgtccttaacatgtcatggacattgtccttaggtagacatatgtttcatgggactgtgtatcatataacatcctttctgtccgcctatggcaccacatcaccatgcccttcggggaaggcagttctacagggtggccaatacaatgggacttggctgtagtttcctgttagcctgcctagattcacaataggctttccggaatctagaggattcaggatgtagttctcgcttgcctcagtggagacttgaatgagtttatgcagtagtcatgaatgaatattcattcttaccatcgctgctgagcatctgagcccgctccttggctttgtggaattccctgagctaaggcagatcttgcctcccattttagagactgaaagtggcagctacttgcttttctagcctcctttgcagctaacaggtggccagatggcccagtcaccaccaaacagacacatcgccccaagttataaccatgacaagggtgctggtagtggctgcagaaggataatctttttagggcagcacgtgcagcacactgagtgggggcatccagtgactggagctagcagtatcagcaatggagactgtgacctcctcacttgacccaagctactgtccaggccgtaggagcctgaacttattccttctgccctcctgctgaatgtgtgatcttctcgatgtccttgtaatgagtgtatattctgcttaaatcagcctgagttggcttggttgcaagaaaaaacctgcttgatgcaagcagctgttcttctccgctccccgcccacccacatgcaaggcataggaaagtcaaactgctgtgaaagccaaggatgcgtacacgcataaggacacaagccaggtctgctcgcagagttcctgtgatagatagacggacagaaaacttgagggccctgcctgcagcacaggcctgggggcagaaagactgtcccagagcttgctagcctggaatccacagtctagatttatactgtccaatatggtagtcagtagtcacatgttactgtttacatatgaatttaaattagttaaaatttagtacgaccactatggagaatgctttggaggttcctcaaaaaaataaaaattaggctaccataggatccagcaatcccactgctgggtatatacccacaagaaaggagatcagtatatagaagagatatctgcactcctatgtttgttgcagcagtgtttacaatggctaagatttgggagcaacttaagcatccatcaacagatgaatggaaaaagaaaatatggtacataggccaggcatggtggctcacgcctgtaatcccagcactttgggaggccaaggcaggtggatcacctgaggtaaggagttcaagaccagcctggacaacatggtgaaactccatctctactaaaaatacaaaaattagctgggcatggtggtggttgcctgtaatcccagctactcgggaggctgaggcatgagaatcgcttgagcccaggaagcggagtttgcagtgagctgagatcacgccactgcactccagcctggggaatagagcaagattttgtctccagaaaaaaagaaagaaagaaagaaaatatggtacttatattaatacataatggagtactaatcagccataaaaaagaatgagatcctgtcatttgcaacaacacagatggaactggagaacattacgttaagtgaaataagataggcacagaaagacaaacatctcatgttctcacttatttgtaggatttaaaaatcgaaacaattgaactcatggacatagacatagagactagaaggacagttaccagaggctgggaagggaagtcgggggctggatagggggaggtgggtattaaaaaatagaaagaatgaataataactattattttatagcacaacagggtgactatagtcaataataacttaattgtacattttaagataactccaggagcgtaattggattgtttgtaactcaaaggataaatgcttgaggggatggataccccattctccatgatgtgcttatttcacattgcatgcctgtatccaaacatctcatgtaccccataaatatgtacacctactatgtacccacaaaaattaaaatataatgaaacaataaaaacattaaattaaattagttaaaattaaatagaattaaagatctgtttccacaggcacatcaaccacttacggagtgctcagcagccacatgcacctacagactaccattatgtacaagacacatagagaacatgtccagcatcgcacaaggttccattgcacggtgatggcctagaaccttgacattccaggctgagtggcaggatttctgcctttttgagtcacacctattgcttctggtggctgacgaggctgggagttcccaagcaatgaggcagcagttccgccctcctccatcctggtggtctgaaatccacaccagctaccaggaccacagagcactgggccaaggctctgggaaccctcttttccctgctgcatcttcgtctatgtcccttttgctacttcttgttggctgcttcagggggagacaaaagtaaagacaaccttgggtcaagttctcaccatcattctcattatcctggaacctggaccaggctctgcagcctgggctggtgcagaggccatctcaggtatgcaaatgagtgtgttatgcaaatgagtgcttcctacaaataaatgctttatgcaaatgagtttttgcattctctatctctcacactgggctgagcagggactttgtacttaccccaggacctggcacagggcttgacacatcaaagtactcaggaaacattcactgggtacacgtggatgtaacacagatcccgagggacctgacgcacgacaataatttccatgcagagtgtcttcctttcagtccaaggcaaggggggtgacacagtaataatgatgataatgagagtgatgatatgtatatgaaaaaatgaaagtatagagtatgagtttattataaaagtgtaaagaaattggttacatgtgtaaggaaatgtggagttatgggcatatttttcttttcaaattccttcaacattgttattacccatatcagagtagttaagaatatgctcagacagacatggtccccctttgtgaaatgggagctgttacctcatttggctatgtaaggactaaatgagataatgcatgaaaaaattcagcactgcctttggcatataataagtgctaagtacaagggagcaattattgttatttttgcctagaaattcgtgtgataacaatagagcggagcgggactcttggcgtccctgtcattttgtggctgttgcttccctccccactggagtggatggaaagctctgggcctgggtgtgatttctgtcctgacagcccagccctctgcccacagggcaactgggccaagtccccactgcgtgctcccagcaagagggcactgccaaacttctcatacctttttatgcttctcggtctaagccatgggggtttggagggatttttttttttttttaatttgagatctgtcatccttgcaaatgagtttgccctttgcagcaaatccacacaaaacagggacaatctccagttttctttctgttgccttttctcctcccttctgttcgagtcctgcagctactaatgagggcctctgtcagctccctgggagggcaggaagagctgccttcgccctcctccctctccctctgtctctctctctcgcaaacacacacacacagactcaggagagctgcccttctcatctggtcctccttttcctcctttcccccagcttctgccctttatcttgctgttttcacacttccttcctccatctctcctgtgactctttttctctgaatctcatcttctcttctatttcctctcgcataataagtgtgatataagtatttgctatgattatgatgtctcccccatctctttctctctttccctctctctcttcctgtgtctatctttgtaatctttctgtctctcttggtaactggctatttctgtctctcactggctctgtctatctccctctctgtatgtatttctctgtcgtcatctttctgtgtgcatctatttctgtccctctcctctgcctcgtctgtggctctctggctggctcttcatgtcccttaaatcttctaagcccctctgagggctgtggtctgagcacaggaagtaataaggaggagtatgccccaccctgaccccagccaccccaaatcctcaccacagtgcctgagaagtggatccgctccctcttggcccaagataaaaatgcatctctcttcttacagcctcttcctacagagaaaatactgttcatggggtcctgcctggaaaaacttctggttgaggaagtcattttgcgatgcttgcaaaacaaactttcagaaaccaaatttcttgaaacaaaatctttgtggctgtttaactgatttagtctactggtaggcacacagaataactaagactaacacgtttatagttaaagcattgcactttatcttcaccctttcataatctactttttgctacttcagcccactcttcttgtttctcagcataacctttttgtagtaggagaggtgccattattattatctccatttttaaaagtgggaaccgatactcataaagatgcgatgatttgctccctgtcacggagttattttcagtgccgcagggcgcagaacgcttattccctagggaccatgagcccctctcgcgcccctccatgcccctgtcagctctagggctctgtgatttccaccagaaatcccaaacatctcccaccaaacctgcccaagggagactctttgtggctttttcgcacatcgtgtcctttgtaagtcatcgttcccgctgcacacgcgcccaccatctccaggctgaacggctcagagatttaatcacgttctcggactcaggccatggcagtgaatcttggagccacgcggccggagctgcagcagaaaccctggcaacggaaggagctctctgagggtttggtggaataaattactcaaacacttgcatttctacaaaagtagtgacacttaattcctgctatgatattaggataaacaaaatgtcatctgccgcattgtccttgcccatccaaatcttatcttctttttccgtgtaagtaattgggggaaaaaaattacagaaaccttctggagtattatcgtattaggatccgattttaaccagaatgctgaaaatttcatactgaaggcaagtgcatagttgccgtaaatgcaggcgaacttcaaggtgaaggaactcccctgtacaatcgcgaatgcaaatgtttaaagccactcaacaattttccccttgcagctgcccgttttatctcttgcaaaactagtaatgatacaagcagttgattatggtttacaatagcaataaacctctcagaattggttgtttccaaaataaatagccattctgttaaatgttaaataacaagtcataaactgctgaaaacaaccaatttcttgtggattattgcctgaataaatttcagcaggaacggcagatcattaagctgtgagcgtcacagatcaaaaccgttggattaaaaaaaaatcaatcaattaacttaaatccatccaaaggaattcccattttacaaaccaagtcacaccacacatttttacatcttcttttgagcttttcctttgctggtcatggttagcttgattctggccaaaatcttttcattctttttcagagattaaagcatacctaacctgggtggttaaattggctcattctgagagcatgcagctttcctcagctgcattttctacaagtctccatctacagtgttccaattgataaaacacagacctgtccactaagttaaacatttgagtcaaggctcagtggcaaatatatattcaaactgcagctctaatagaggctgttctggtaagagaagccaacttcatcgggatgattgacagaagattcctcgccatagcaaccagggttatctctctggaataacaacattaacctccttcataaccagtttttcatccctgaatataaaaggcagctgcatgcatcttgtatgatcctttttttttatttttgaatgaacagttagcacttctatataaatgggacaagatgcagcaaaatcaaattaattttgaattcctcttgaaaaaaagcatggcaatggatcttgtaggcagaacagttagagcaggaagggttcctgtctcttctgagcatagggcagtagcagtgagatttctagtcatctactgcctctgaaatagcctcctgcattgatttgctttctgctgctgtggagggtgggaaggggcaaataatttgtttcttgttttgttcctgtcttattctttgtcctcacaactcccaacgcatgcacacacacacacacacacacacacacacacacacatccacacacatcttagaggctctcaggtgcaaggcaatgaatggtctatgggaaaatggtgggaaaatgcatattctttctgaaaaaaaatgtatattccatcgctttttttgaaagaaattgctaaatggaccccaaaccatctcctctgacttatatctaatgttttgtgaaagccgtggacattggtgccttgaaatgtcactgaagcctctcaccagcccctcacagaggtgctgtgccatgctctggacctgacttctcatgccagtctctgcaagtagcaagcatggcactcaagccacagggaataaaaactgtgacaaggaaagacagactgtccacctggttggaccactgccaagtcatgtccttccctgtgtcattccatctaggatatttttcccattggcaccaacttcattgcaattgccaccttgaaaagtggagccctcttggttgaggcttctgtgtcactcaaggtcacaatcttgttgctcaaggccctggttgtaacctcaaagaacgtcagtcctctgctgaggaaagaggctgagcagggaaaaggtgccacctgggcccaagcaaggggaacctgggaacatggcatttacaaagtgcaggacagcgtggggcctcagaggggaaagtggtcattcagcagaaacactcgggtgaatctctggcctgatctctatgtaagcagacaaactagccaaaaggcatgactggtggatttcaaaagatgttctgtgaagaaatgttatttctgagttggaagtaggaggaactctttgagatccccactgtattacacaaatgttgacagcctcctcagattccttcaaagccaccttacttccaaagctgctgcctgcccctcacacccctcaccccaccaacagcatcactgtctttgccaagccctggaactgcctggaatccagttggggccctgagtctgtgtgaccctgttaccagaaaggggtctcaattcagaccccaagagagggttcttggatcttgcacaagaaagaatttggggtgagttcatggagtaaagtgaaagcaagtttattagagaagtaaagaaacaaaagaatggctactccataggcagagcagtggcatgggctgcttgactgagtacacttatgtttatttcttgatgatatgctgaacaaggggtgggttattcacgaattttccaggaaaggggtgggcaattcctggaactgagggttcctccactttttagaccatatagggtaacttcccagtgttgccatggcacttgtaaactgtcatggcgctgatgggagtgtcttttagcacacaaatatcacaattaatatataatgagcagtgaggatgaccagaggtcacttccatcactatcttgggtttggtgggttttggctggcttctttactgcgtcctgttttaccagcaggggctttttgacttgtatcctttcatactagtcctgccaacctcctatctcatcctgtgactaagaatgcctgatctcctgggaatgcagcccagcaggtctcatcctcattttacccaactcctattcaagatggagtcactctggtttgaatacttctgataaccccatccccactgctgagcatcctcattcctggtcacttttccactccaggatttggataaaataccacagccatgggcatgggacctggcctcctgagcagctcctgaggagccagatgatacccagaaatgcaaggtgttacctccatggtgtgtgaacctgaaccaaggtaactggaggtggagagtatgtcctccctccaccctgaggtgtgattcaacctggctaatcttctgcagaagtcccatgagctgagcggacacactcagggcagtttgtgtctctagccactcaccaagaagcagcatctagagcagcaccattgcatcaccttgatcctcatctttcctgcctttcctcctctttctttcctcacctctccaaggttacacctctccaataaagcagccgcactgtaatccttgcctcagcctctgtgtggaggacggggctaggaaaactagctacatgagtcatactcagagctcctccctgtggcaagcattttaggtaaaggagtaggtggtgaaaatcatggcctttctctacgaatcagtccaaagactctccccttcatttgctaaatgacccctgatgttacagccacctctggaagctgcaagtttcccaaaagctgaggttgaggaagggtcggttggttaattgtttttaagaagcagtgtaatggaccttattacttaattgacaaagggcttgactggtggaaaatgaagcctccttgcctccaagatgttgcaattagttttctttaaaacagaaaagaaatgttcctgaataatcaaaagaacaatagcaatagtagcaacaccccaagttacaaattgcctgggctattggcctcctttaaacacacacatagggggcattgctttttcctgtccagaggaaagaaagctgatgctcttcccctctcactcaatgccctcctcacaaagtcttgctgaccctgcctcgtgtaaatatttcattatttacgggtgtgttggtttattcacgcacctgcccagccatcctgtgatctctctgtttgtgtggagcctgtgtgtgactagttggttgcagctggtgctaatgaggccaaagcctgggttcaatccccaagggggccagttaacttcacctgctccgtggctagaggctgcactcaacagctctgaatggagcttgtgttgtgtgtactgggcgacaggcacaggggtagagggaagggaggagatggttcagcatgtggtccccatgtctgctggagaaacagccacagcccttggcaccttccacccctgcaaaggtcagcactgtgtttcttgttttttttccccctaagattacttcttttatcctaaggttagaggacgtgggcatgtatgttttaaaatttcccctttttatttaattggcaagtattatgtcttatgagttaaagagtaaggcacatttttttggcctcaattcctttgggcatccattattcatttactagaacacacagcctactggagaggtgcatctgtggacatcagaaaaaaaaaaactaggaggagttacagattgtggcataaggtttggtgaaaatattcaagaaaaaaattattcactcaacaaatacttattgactgcctattatgtctcaggcactacactaaagatacaatagtgaacaaaatagattttaaaatttctgctctatggagcttaaattccagagggagaaggtggtgcaatagatagtaaataagaaaaaggtagtaaaaaatatgtattttacataaccataattttgaagaagaatagagcaggaaatggacagaagtcactaggaagggtactccaactataataggatggttaaggtagacctcagtgaaaaatgatgttagggcaaggacctgaagtaagggagagtgagctgcgtagctagcagagggaagagcaaaggtgagaagggcaaggagggagcatgcatagtgcctggtatgtttgaggaacagccgggcgggggtgcagtgtggctgaggcagagggagtgagggagaggcgatgttcctgaactgaactggggtgtgctcacctgctgcaataagatcaaacatccacacagaggtttgcagagggagaaaggagggcatttatttgcagggcaccaggcaatgttgattgggcagctcatgcttaagacctgaacccttgcaaaggtttgcaagcgagggtttttaaaggcaagggaaattttcaggaaaacaagttaatacaggcaaatttaaatcaaggcatggaggttatacattggtttggcctaagaaggtgggacaccttgaagcggggcctttacacgtcataggtgggttcacagattttctgatttgcaattggttaaggaaaagaagctttgtttaaaaatgtggggttagcagaaaagaacgttagctctggctcacaggtgtgacttcttccaggcccatcaggaagaaagaacgaagagcagtggtcggagttcagtccccggttcccccttatccaaggtctgtgtgccagcagatacatttggtgggggtccaggttttgaaaacaactcagggacatacgttaagaattaatctttagtttctatagggaaccaaacatcccatgactctaatttccttggctattgttttaggctactattaccttcttgctgatcaaattgctcatttacttctcagggccagctaagtgcctgcaatctgaaggaacttaagatttttcatttccatgcttgtggtagtgaggggggcacaggcccctaagaggggtccctgctccatctcaggatgggagatgcagccaagaaaaaagggaggaaggagaatcaggtggcgtctacaggcccttgcaaaagctttggcttctttctcaaaaagttagaaaaggcttcctcaaagatgttgcttctgagtcgggtcccaggagctgattagtgttaactcattcatctgcactccggctgaagcaggtgttgccagactgaccgtgtaatttggtagttaacatgtgtgtaccaggctgtgttttcagacttgaagacagagtggagttagcatctgctcctacccctccctcacccaccccatccccacgcactcatacacactaccggcctgggagtcatatgaagcttatatggtcccaccatgggggcccacacaaggaccgggattagtttgcccaccagccaggcaggtgggggctcagaacagataaagatttgtattatttcttgagccacagttatagatgtcagctcatgcttgctaaagaaacaaatgaaaattaactggcaaggcaaccccagggcaactgaatgagggagaaagcaaacactccccgggttccaagcaggaaggagccacatgggggctactttgggggcatggaggaaaaggtaattatagaacactttgaggagcagataagatttgagtgggtcttgaagcacaggtgagtgtgaatcttcaaatgggagggagagcatgacaagtcattgttcctttgtgaggggcggtaggaatttttggaaatgttcaggagtcaggaagaggaccatctaggctagaatggagtggctgtgtaggaaaagggctggcagagagtgaggcagattgtggaagtcccggaatgccagctggaaaagtttggacttttgctgagggtgattctctgctttggatggcaggactgtagcagacagaaccatgtctgttcccatatgcatataagtatgtgtgtggtagcctcgccagatataaaatgcaagggaaactctgttaagtttggatttcagatcaacaacaaataagttttcagtataagaatgtcctatggggccaggcacggtggttcacgcctgtaatcccagcactttgggaggccaaggcgggtggatcacctgaggtcaggagtttgagaccagcctggtcaacgtggtgaaaccccgtctctactaaaaagacaaaaattagccaggcgtaatggcgggtgcctgtaatcccagctacttgggaggctgaggcaggagaattgcttgaacctaggaggtggaggttgcagtgagcttagattgcgccactgcactccagcctgggtgacaagagcgaaactccgactcaaaaaaaagaaaaaagaatgtcctatgaagccaggcacagtggctcatgcctgtaatcccagcactttgggaggctgaggcgggtggatcgcttgaggttgggagttcgagaccagcctggccaacatggtaaaaccccaactctactaaaaaatacaaagaattagctgggcatggtagcgggagcctatagtcccagctggtagggaggctgaggcaggagaatcgcttgaacccagaaggtggaggttgcagtgagccaagatcgcgccatcgcactccagcctgggcaacaagagtgaaactcagtctcaaaaaaaaaaaaaaaaaaaaagaatgtcctatgaaatatttggcacataaatacaggatgcccaggtaaatttaaatttcacataaactatgtacagtttattttatttattttattttatttttttgagacaaggtctctctctgtcacccaggctggagtgcagtggcacgatctcggctcactgcaacctccacctcctgggttcaagcgattctcttgcctcagcctcctgagcagctgggactacaggtgcatgccaccacacccagctaatttttgcatttttagtagagatggggtttcaccatgttggccaggctggtcttgaactcttgacttcaagtgatccgcccacctcagcctcccaaagtgctgggattacaggcatgagccaccgcacccagccaaacaatgtgcaatttttaagtataattacatcttgcaatatttgggatgtagttatgctaaaaaaaattcatcactcatttgaaattcaaatttaactggacatgctgtatttttatttgctaagtctggccatcagtatgtgatgctgaataaatgctacttaccagtgctgtgaactccagggcagagctccctcctgttacactaactagcctggagagttccgccaccagagagccaatttctcggccgcctttgggtgctgactcagctctctgatgacccaagtttatgagttacctgtgagaatatctgggcccccagttttctcaagagtcagccccagatccccaattctgcctctcaaaatcgaggaataggagccctggctttttccagcagcagctggaatcaataagcagccctgatgtgtggggtgggctggaacacagcctgctaccttgagccctgcagtattgatcgcacaggcagctgtctgtaaaccaagcaggcatgctgaaatggggtagtgttgtcagccttcactttcatagggatgactcttcagatttctctcaaagcctgtcgggctcaaagggaaaaccagcaagttcttttttttcactaatgtaatgccttggggagctgccgcattacattctttttttcttttttcttttttagtgcaaagttgtgggggtggaaggcagaaaccacaacaatcctctctcttttgggactctctctcttaaatgtggtccatcattcagttttaataactgaagcacaaaatatgaaaactaaaaaaagtcattttttatcgaaagcctcaaatgtactgggcatgagagcgagcagtttgtatgtcttgtggtgttttatgcttctaatgattctctgagattgatatttattactattcccattttacagattcagaaatggaggctcacccaggctaagtaatttgctcagggccgtgcgtcccgcagtgagtctgctatggtcgaaacccaggtctgtttgacatctaacactactgtctgctcaatgagcccaagacattgcaaacactgctggcttgtcatcctagcttgtccttttagattcctgagtgatgaacatcctctgagaaactgtccctggttgctctgaaaaaagccgggtacctccctctgctctcagatgactttcttcccacctgtgtgttgtagaacctccctgtggggctgtaaaaacacatccacctttctgtgtcctcattaatccacaaggtcctccagggcagcggcaaaattgtttttctaccaagtgtgctcctctctagctgcagggactagactatcgtttagcacacaagctctataaatatctgctcgtggttattactgttttgaaatctcttttcccatttgtttagggagcttcaaggatgctgtcctgtcaccatgtttcattgtgatgccggtcttctgcgttcttacctatgttttttacaccgaattttgtattggcctgtcctcattgaggactcatctggctggtccataccaatattaacagaaagttcttccatggttgaatgactgaacaagtatggttgccatgatgactatatttgcacaaatccaagttggtcttctcaatggttcttcctataatttggtagaagggtatagaggtaaatgaacccaatgggtagccaaattcctgcacctgggatctcaaggtcaatgtttttttttatcacagtgatatagggtgtctcttggagactcaagagaaagagggttgtcaatgagagagggtaaaagatgacagagtggctttgatcctaccttctcacaaaagcttcttagaaaagtcaacctacttttgagaggagcacaggttctcacaaaaccccttccaggaagtagagaagcaaactttgccatgattctgctaccaggagtaaacatgtgatcccacatgtactctgccccttcagggatgaaagagctatgaagctgatggttgatcctcagggacagacattggctgagaggacttgatggatttcagatctgcccacctgaagcccaaacgctgaggaagtctctaaatggggattatagcatttaaacattttttatctttatgttcttctgcaggtctgaggcccttcagactaacagtgatccccctgtcacattaattcttctcacatagactgtttttcttataggtcctatctggggcaaagatgactatgacagaaatctcagcttgttcttgctgacagagttaaatttggtctgtgtttgctctgcacaagaagaaagcctgaactgtgctgaacaactgtcttgagggcacgtccagagccacgtttgtctctctcatgttcctccttttattgtttttgttcctgtacatatttcagtgatgtcaggattttttttaagcctccaccttaggggaagctcaagaaatggtctgtgttagcactggtgaggccaagacagttttatgcatataagcctggctgtttgttgatcccttggaatgagaaaccaattggaatatcctggctgtgagaaatataacccttgaccagccaaagtcatttgtctgccttccctgttgaaagaagcacatttaaaatttctcacctgggagaaacttcctggaaagaatatttcatgcaaaataatacacttcttggacctgagttgcaatttggattagaaaaaaatgacctcattatgtctgagcatatatttttgttagaagccattctgagaacaagagcatgtggccgggtgcagtggctcatgcctgtaatcccagcactttgggaggccaaggtgggcggaccacttgaggtcaagagtttgagaccagcctggccaacatggtgaaacccgtctctactaaaaatacaaaaattagccagacgtggtgttgcacacctataatcctagctattcagggggctgaggcaggagaatcgctggaacccgggaggcagaggttgcagtgagccgagattgtggcactgcactaaagactggagacagagcgagactccatctccaaaaaaaaaaaaaaaaaaagggggcatgggttattcaagggattgttgagttgtttatacatgatctataccttggagtaggttttggatgcattttgctccacatcccgaatgaggggtttgaaggttgaactgctatgttgatttaatgctgtggttgctagggaggaggccccagaaaagttcagaatgttaaaatcaagtgttaaaatatgctgggaggaaatgcagaacagttctcaatttccatcatgagagctttatagatagttactggaagaaaaaaaacctccaaaaattaaagtcagagatttatattttgtacacattttgaattttggagaatgttacttcttcctccagagatcttgttttgctttttaaattagccaggttttatgaaatacattccctaaggaacgctgaagaaatttccaatcaagattcttagtttctagtgctttgagggcaacaattgtacccaaaaaatttctctctttcttagaatctgccacttccagaggcctgtgcttggaaggcaggtgaccaagtggcatttgggtaccttgctggagaatggatgttagcacctgctctggggtaactagggttgccagtcctgctgggcaattggttatgcatctgttgcagctgtacactttgcgaaagatggatgatggggcatgactgcagaaaccttagaaattaaaaaagatatattttatatatatcatcagggagatcttgagaatttgccattcagagtatgaccgggagaaacaagactattttgaatccacaggttcaaatacagcatagaagatgcaggaagtggtatttggcctgatgtttctctcaatgtcattgacaacaacaaggatatatgctaaaaccagatggcagtgccttcctgatttctactgaggaaagctgtgcttctcgaatgctaatgtgtatatgaatcaccagaggattgtattaaattgcagattttggttcagtaagtttgggtagagcctgagattcttgcttcttgagctcccaggtgatgttgaagctacaggggcaggatccacctcctccctcactcttgccaggagaatacccaacatctttccagtgtctatcagactaggctgagcacttcctctaagatctgctgaaccctggatactcaagtttgcaacacaaaggaaggaaccaaggggtagaaactcccctgggaagagacagtgttctctgtggtagaattggggagggaacccaaatggaagcagggaccccgaaggagggagctggatggagaaaacagggtattagcaagacaaaggacagggagggatgtctccatgggaagctgaagccctttacaacctccaccttccaaagactcaagtctgcaaggctgtccttctgcaacagaattcaatggttaaatgaaatctacttaggacttctatttctcactcatggaaatgctactttgagctatatctgatctttcaataaataactttctcctggcaccactataatctcgttatcatacctatatcagcaggacacagtggggtaccaacagaaaaccccttcattttctcttactgttgtctttcaaccccaatcctccctgaccttggacagtatctaggcccaagtgcatagcttttctgattacttccaggtaatgatgtacacacttatcatcagatattaaaaacttcaaaaacaacctgatctcaaaactgtaatctctcatcctatttcaagcttctcctctctctctagctcagaccagactcctgcagaaacctgcagggaaagaaggtgtgaacaattccatgtcctcccccgctgctctgctgcttcgggttcaggttggactgggagagggcagaggagcagcaaggggagtcaggagcttttcacctgagctgttggaatctgcagttaggaatctgccctctgtgtgacctgagtcctaactcagctgtctgctagttcccaggataattccaacaggagcacttaccaagtaacgacctatatcagcactcttctagatgtcacgggaaatgaacatcctcaaagtaactctcattgcagagtaattcagagttggcaatttgatttttctctttcttggtctcataaattgttctccctctaggaaagctgtataaattcccactaaaagtggcccttgccttgaagactggtttgcaggcatgagacctttccctgggttactggcagccctttaattcacgtatgaagcctctttgtcctgcagtcacgggtccaagaagatggctcaggataggcagccccacattttttttgctcaacatatatagatgactggaagtggaactattcaaactactaaaactttcagacccctctccagaatttctaggataatgtctacaaagtacattctaggtttagcataagctactatggggaaaagaaagaagagaaaaagagaaggaagaatactccccagaagtccaacctcagaggctccgtgggtttctggtcggactgccctgatgctcagaggacaaacatcaacttggggccagtgtgaggtgctgaccccttggccagatgagctggattatattcacgcctcgggtcctgctcacagagtgagaatgaacccttaatactttgctggattcacaagagggcatctggttttaaagattcttttgctgtgggttgaattgtgtctcccctatgctccccaaaaagataggaagtcctaacctccatactagagatgtgatcttatttggaaatagggtgattgcagatgtaatcggtttaggtcagactggagtagggcaggccccgaatccagtaagactgatgtccttagaagaaggcagccctgggcagacagagacacaccaggagagctccaagtgatgatgaggccagaaccaaagaaagccacaggatgctgaaggcagagatgtaggaagggacaaagaagtatcctcccttagggctttcagagggagcgtggccctgccaacaccttgatttccaacttttggcctccagaactgagacatacatttctgttgttttaagcaacccagtttgtggtactttgttatggcaacccagggaaactaatacacctcatatggcccttacaggaggatggtaactgcatttgcttgcgagcatatctgatctcacgcaatagcgtggaagctcctaaggttccctggagcccattgcctaacacagaacaaatacagtgtgtgccagtaaattttggttgaatgaacaaatgtaggactttcaatcttaatggtagattaaatacaaacaaaatataagaattaacaagggagaaaggcatacctagattggtgtgtatatttcattcacaacaacattatataatcttgtttatgatttgcataaatgagctattatgccataatttgaaactcaaatcggtggcgtctccctgcaacatgaatgagatgaaacaagtcttcctctcctctctgcatgttaaagatgattgctgtgttagtccaatgatagatcccggtcttcactgtctcataacgtctcagcatcttttctggtttctcactggggctggaatagctgctgagggactcttcctgcctgtgagatttacattatttgagatttaaagcaaacgctatttcaaaactagcagtaacttcaataattggtggaagtgattgccccaaggtggaatctccggtcatcaatttaacttacctagttcttaatctccagaaaatagctggcctctgaatcattgctgtatacttaagaggccacgatagaagagtcccagggccttggaaaagatttgtggtgataatctcattgggactttatttcttcatggattcctttctgaatagcaacttagcacatacacaattgagagggataactgcatgtatgtgtgtgcatgtgtgttcatgcatggagtacaaccagcagaagagaaggactagaggacccatattgcaatcacttatgggaggatgcataagaaaatacaagggagataagaaaaagaaaacctaataaattagaattaattattaattgcaaattagtaaccaattcctttaataattttgtctctcttttcacaattctttatcttttgtatttaaagattctggttccatttggtgatattcatttgcttcttattcaaatgagatgaccagggatagtttgggggaattttttttggaccctgacaggggtcatgtctttcaatcctatccctaaattcatacccatatcttcttcagtccaaatttaattcagcccaacacatatgggatgatttcctatcttatgccaggctcagtgcttgacagttgaatacgaagatgagtaacacggctccagattatgaggagtttctaatctggcaaggggatgagatgcattacctaggtgtgacagggacctttcattttctgtccttatgggtgatctttgccaatccctggagggcaatcaagaggttaagacatattgcctcccaaatctggagtcttctctagcttctcccgggttgtgagtctcttctatgcagctgatcctacaggtgatctcaaaagcatcccacccaaagggttgtacaggcccatttctccttgggccaacctacattttagaccttgccaaattcaatacttgagactacaatttagacacatggaattctctaccgaatggctattggtttggagtttccatttgggttctaaccaattgagcaatggtgcaagcgttccccagggggaacaaaaagtgggatctattttattgtagatgcagcgagtgcccagtgacctcgagaacatggggctcctgggcaacgctggactgcagcattgtggggcccccagaaccaaaatctaccttccgattccttccaccagaatggaagttatgtggctcccagtgaatatcaggctgacctcattgagtcataaatgaaggagaaagatgagatagaagagaggggtgagcctgtttgggcttcccaataacaggcctgtctggtatgtgacccagcatggagcctgaatacaaaggacccatcctgcctgagcatagatgggccaagagagcaagacaggggctgaccctgttttctacttttaaagccaagcaccccactcactggcatgtgggatgtgatcccaagagtttctgcctctcttggatcacgaatcaagccagtttttttaagaaggggaaaacagtaaaatggggatccccccttttttttaagaaggggaaaacagtaaaaatggggatcaaaatgtacattcccacacttcctatcttggagtggaaatctcctttcctctatgaaaacctggatgtgctgttgggtaggggaggcagctgagaatgttcctggcaatgaggcaagcaaactactactagacaaaaacttgcaagactatttccaagtatgtagcagggattcgagttgaaattctaggtagacatttccttctcttgtaccttcccattttggccctgcatgaggaggctgtctcctcagatgttccgtgagcacttgtcctgaatttcttccctctgatcatccactctgcagctatctcctcaggtctgtgagtgcaggaacaccacatctgtgtagggaaaatgtcgtgcctctctacgggttgatttaagactcttgtgacctagagcttcagctacatgtgtaatgatgttttctgctgagtcaccgcagctgctgggtgcaggtgggctgagaactcctaaatgggacccagggaaaagctacaggtgggcttgtcaccttacaagtcatctatgaagttgcaccttgccttagagatcacacagcctgaccctataatcctacatggagaaaggggcatgtttccaatttgcctttcttttagctttgcctcttagggacagtggacacctcactgcagggcaaggaagcattggatcctcttctgcccctcccaggcctggctgccttatgaggccatcaggagaaactcgttgtcacagagtgagtgacgatgtcaagtgcggggcagtgccgtggattaaattgtttgtaggtcttctgataaaagcaggcaggaaagagggtctgcaggttgctccaacatagacacataggtaatagagcttattcaggggagggaagagtgagaccccacaggaagtatcaataagattttgaaggttttcaaagagtaaaaagctcaaacctaacaggcagtaagggatgcaagctggaggcagtgctgcgggaggttgggggaagcagatggaagagcaaggacctggggtgaaaaagcaaattcagcctcggtttgtgttcaggcaaagggagggtcagcttttggctgtggtatagaaaatcagtaaggaagtgagaagactggaaaaggcaaaggggctgaaagccaggctgcagagttgatatttcatacgggagtatcctgcagttattggaagagtctgaggagaatgatctgatcaaagcagcactttaggaaggctaatctgtcacagtgtgtaggagggactggaggagaaacaggcaggaaggcagaggtgggagaactgtcagctaggatgaggatgacgatggtgatgaaaagatgatgtaaatcgtgaaaaagatgaagatgaggatagcagctaagattcattgtttattaatgacattcattattctaagtactttgtatctgttatcttatgtaatcctcacaccctcctatgaggtgagactgttttacaaataataaaactgaaaaacagagaagtaacttgtccagggtaactagctaataagtggtggacctagggtacaatccaggtgctctaatttatttatccaggcaaaatgcaatgagctgagcaaaagcagagtggtggtcatgggaaggtggagatggattgggatgtcacagggttggaggccacctgatcagatgtgatggcaggagagaggtaggtggattgggagaaggaaaagtggaaagggccatccagcttattgccataggtcactggggacatagtgggaatatcaattaaaataggggtgcccagaagagggactggtttccaggtgaagatggcacaccagtcagccaccaccatctctgatctgcagtgctgcaattatgtctctttgtcccttacaatcattctttacatggcaactcctacatgatgtaaagcggatcatgttattccccattaacatccttcaacgtctccacagctctcgaatctaaaatccagtctccttactctggcagacagattccacaggagctgccccagcctctttctggcaccgtgtcatagcttgtggctgcatcactctaacccccaaggctagtaccttcaaatctctctatgctccatcatcagattgctttctcctccatgtgtcaatgtcagaatctttctctgggccaaatgcagtggctcacacctgtaattccagcattttgggaggccaaggagggaggacggcttaaacccaggagttcaagaccagcctaggcaacatagtgagattccatctctacaaaaaattttgaaaaaattagctgggagtggtggtgcacacctgtagtcctggctacttgggaggctgaagcaggagcatcacttgagaccagaaggtggaggctgcagtgagccatgttcacaccactgcactccagactgggctagacagtgagacctcatctcttaggagaaaaaaatctctctctgcttctcaatcagaaagatacttatgtttgtacttagggtccactctgagaatccaggataatcttcccatgtcaagacccttatttagtcaaatctgcaaagaccctctttccatgtaaggtgacatgtataggttccggggattaggacctgatattttatgggaaccattacctagcctcctataatttctgctgccctccacttactctgtgcgggaaatcagctgtaccctaggtgcctagaagggtaccaggcacattgtagatgctctactgtgatttattaaactagcaaataaatgaatatagccaagtgtattttattctaaaaagtattttccctatatgttcataatttaataacaatacatcatattgttttaattctaaaacagtcaaacagctttgatacgacagtcatcttatataaatgaaaacgtgatctaatgaaatggcattttatgagctttaggcgaagcaaccatttgaatgatcttgtttaaattaaatggcccttttgtgttcagtagtcagcatcactaagtgtgtctatcttgctaatacagtggcatcattataatctaaattatacaatttaattacatgtaacttgaagctgaaatattggtgaggtacaagtatgacctttacatcacttattaatgttttttcaaatgacatgacactcagaaaaatttaacaaaatcttatgtttttgaatcggcttatgaatcggctaaataaaaccttaagacactgacaaacccagttccaacctttgctttgccatttaatggctgcatgatcctgggaaagatatttgagtactccaagattcacagtccccactctatagagttcttgagaagagtgaaatgagttaagcatctaaaatgtgcctcccaattactagccaatattagctccctcttcctccttcctttgccacaaacataccaggaaaaataaaattctgttttagatctgataaataattcctgaaacccagcatagcaaacataaacacactgtcctaaaatacatgggcagcatagtgtgtagccatcatgagccccgcctgcttgctttcccactgcattatgccctgagaaattgccccatgtgttttctggtgtttgattctgtgccagagccattagggtagaagaatgagaaggagttgagttcagtcctttcagagaggacactctcctttgggcatctgctggttatgagggagcttcttgccacaattcaggctgcatgctgctggcagagggaacgaagggaatgcactgtcagaaggacagagagacagagaagcagacagaagcatggcgatggccaagtgttctttagggagaaacaggctacatacgggataagatttttggaacatgaaagaagggttactttaccaatctgaggctgctcaggcagtggtgccagaagtcacagaacatataaagcagagtttttcctcatgcagtcatccctcaagatccatggggtgttgcttccaggacccccttagataccaaaatccatggatgctcaagtccctgatataaaatggcacagtatttgcatataacctacacacatgctcctgcttaatttaagtcacctatagatcactaacacctaacacagtgtaagtgcgatgcaaattgttgttgcattgtttaaaagttttatgattttttcttattgatatttttaattgttttttcaaatatttttgatccgtgcttgattgaatccagattgcggaacctatagatagagagggatgacttgtttttttccttctgttctccctttattccagctcattatttatttcatagaatctcaggtttggagaagtccttagagatattttggctcaacctccttctccatgcagaaatctcctttacaacattcacgacagatggccattgtggtgttgctttgttataatttgttttatttagtaattggtttttatagaacaccattaagttaaacagtttatttttcaaggctccatggaaatggctctctttaccatctgtgtgtgcctctcatatgagattagaccctgggactttctgccccttgatggcctgaactattagtaagggcagaaaagggaaaaggacttgcctcacttctcaatcaagactcctgggtaagattcagtgccagggaacggggagggaagggtagcaatgatttaaaagatatttactagcttgagaaaggtcattctgaccttcggtgttgtttctttaaaaataatactatttgagattttctgattatgcaagtaacccaggtgcacaaacttttaaaaattattctaaaagcacacaaaattactaaatatttgggagttctgcgatgatactgcttcttcagttttatattctgccctttttacattatagtgtgtcattacatgttcttccataatataagtcctagttatgtatcatattctgtttcatagctgtggcattatttacttaaccagccccttctggtttcctctcacctcttgcttcctcatgctggtcagaaaagctgcctctggcataagcacttcttaatctgccttgactttcatccagacacataaacgcttgtcccaatgcatttggatggaatgatacgattccagagtgtttcctgggagtaatcatggtgttgctgcggagtccatctttgggctttgtgtagttgatgtgttaattacactctgtcaagccacaaacttctattccccaagcctctccaggcatgcacaatcatctgtgtgtcacactgcaagtgaggataagtctaaatggaccctttaaatcagcttggctgccaactttggctctattgacttgtcagggcccaggcaatggcacagccagcagtcttggcccatattgaccagaatgggctgcagcagaactaccagcctcgcatcctgtgacaaacgacccaggacaatgggtggtacctgggctcccgctctaggagcaggcagtcctgctaacataccaccgcttccacccctgtctggctctctgctggccctgatccaaatggggcattgtgctttgttattgttgccataagaagtggcagcagggcctggaaatgcaaggtaaacatttgcaatgggattccaggggcatctccatggcctgatgctttgaggaggacagaaataggaatactaatgtcccagaatctgaatctgtctagaactgactgcttattgatgtgggttattttgctctgtaaagggacacacacacatacacacctcaaccttttagaagaaatcctgggttaataatactccacctgctggttccatctctgagttccccattcttggtcccatttggtcctgactgaactgctgaccatgaggctgacctcggcccttggtccttggtccttgacagtcttgagtctgatgacctccacctcctcttcacatggctccacattgctggatattgtcatcttgcttcctctcacatcctttgctagatatgactgctggtttcaagaggggcccttgggtgtcaggctaggagttgttgcataaaagaatcccctttgggtcttctttgtgatgtgctttgtcactgggacttaagcagtgctgcttgtgctctgagtctcatgacagcaatgcccaggctttagcatgtggctctggagggagcaggcatgggccttcaggaaccagagcaggaaaggaagacaaatgatgatgctgtggtggcctgtggtagcaattgattctggctttccgctctctcctccctagttacagaccttgtcttctagctgaaaagacaggctcctgatccaggcctagccaatcacagtgcccctttccctggacacagcaacagcccaggcgtgggtgtgagtcccacacagagttcatcagagtctgtccctgggattgattcatagatgttgggagagaaaggtgcttcctttccactgggtttgctaagcaagggctgccatgtggtgtgccatgggttacagagaaaacaaagctggtacataaaagagagcagagacagacaaaaatgagagacgggaaaagagaagcagcacagcagaggtgctgagcactagcatggccctcgaggctgctgtgccctccactgctacttcaattacatgaaaagctgcagcatctttctcaacaatgggagcccattattctctcgtctttcataagcgagtttgtgatgggctctgacacacatggccgaaagggccctgcctaatgcactttctgatgccagcaggtgccagtttgatttgtgaatacagatgagacatccctccaggaactttaggaaatagcataaggacactttgaggaagacccatttcctgcaggcaagcaggatgaagtcttctgccataataatttggattataaaagggaagtatgaccttgtttggatatcataagctggtgagccagaaatatgtaggctattctctcaaaaattcatacacatctcttaccagattggcttctggctggacctcctgcccccggcccaggccccaggccatcagacctgcttagaaacttgtctgaaactgagccatggaggtcgcctgagctggatgcaccatctacctcacccaactcaacagagagaagttcctgcaagagaattgtgaggttttagtggacaggtgaatgtagagcaggagaaataatcaggagtagcatcaagattggagactggggaggcaggtgtttggtgaatccattaacctagagaaaagattattaagggaagaggaggtatgtgggagagactaacttagagttagatgtattacacacacagtaggtgcagaacgcctggctctactgtgtctgctgtttcaggaggtgcttggaaacataggtctccctctcagaaaagagctccaggccagcacatacacatgtgtatgtgtgtgtgtccccttacagagcagaataacccacatcaataagcagtcagttctagacagattcagattctgggacattagtattcctgactatttctatcctcctcaaagcatcaggccatggagatgcccctggaatcccatcacaagtgtatgtgaagtagaagtagacgtcactggagtgtaggtgaaatagaagccatgagggttgaataaaattgcttaagaagagcattatattggtttcccagggctactataacacattaccataaagcagggtagcatgaaacaacagaaatttattctcacacagtttcggaggccagaaatttgaaatcaaggtgtcagcagggctgtgctccccctgaagtccctaaagaaggacccttccttgactcttcctagcttctggtagttgctgtccatccttgccattccttggcttccatctgcaccactcctatcgctacctccatagccacatggccttcttccctctgtgccttcctatctctgtgtgccctctcctcttcttacaagcacattggtcacattagatctagggcccactctaatcccataggacctcatcttaactatttatatctgcaagatcctaggtccaactgaggtcacattctgaggttctcagttggatctgaatttggggttggggagtgctatttaacccactataatggtgaagagagaaaaagagaaagctaaaggcagaatcatgagacgcacgaacattctggtcgttagtagggaagtgttagcaaaggaaagagaaagagagagagagagaccacattcctagctgctgagaggccgggtggggatgcaagcaggtaactgtgtgtgaccatcagaaaacactggtaacggcagttgggtgactaactaatatatttcacccaggactagagtggcagtccaggatgcagaactttcggtgctaaaacccaacagtaccaagcacactggaatggttggacactctacctgggaaccagcagttctattagaactgaatgtggggagaacgcacggctgaagcttaatggcttggggaatgagtaagccttaagaaatgtacttgcctggggcgtgattctggttgcgttgtttttctgacaattcaaccacatttggaattttcttacgtaggatatgggcttgagtttttaatttaaagtcttcgggtaaggtcagctcagtccctaaccaccggacatcgtggaacaaccaagttattggagattaaagtgtccttcaactgtcatgaatgccactctgaccctccttgtctggaggggacctccagggcatgctatttaaatgaacccaattttgaaagttcacctatctctactgaatgtgatagctatcttgctctgccttcagagcacttatcttcaaagtattcagcgccaggcaaaagccttgatttttccttgaaaaagaaattgtcaggatgtctgaatccatccagacctttgcatgtgtgatttcattattcatagtcagcattcctcttctggcttttgatctgtagtttacagaatgtgtgcataaggaggctctctttcccataaactgatctctttaccctctcagcccggaataactttccatttattcttttgataaagcgttgatgccgtgagccagcatacattaaatttatcatgatacaaacacagcactacactcttatccagcccagatcagcaaccagatcactgccagtgcccctcaagtgtctctgatgatgaacagcaaaggggacctgtggaatttctcacgaccatcaaatctgaagaaggaattcttctgagagcagtttgcaaagtctatcaccagtatcctgactctattattagcttgcaaggtagttaaagatatcttctcagccttgactcactaataagcacttttaaatatatatcaaaaagccctcttaattaaaatgcttcaactgctttctacctctcttctgataaatgccaatatcattaacatggctgctcagaaccctgcctgcctctccagtcttgcctggccccagactcctctttcccttctgctacttcccctaagttgaatatttttcattcttctttcacctgcttatctcctactcatccttctcttgtcatgtcaattatcactttcttgaggaagcttttcctaacccaccccatgtcccatccacctacttgcccctgatccccaggatacgttagagacctttgctttcacagaactgctaccaagtcaagataggctgacatgtgaccatagcaagcaccaccaaaacctcagggtggatgaatgaggatccacactgcttgagacactcagcttccaaggccaagtccatgaacctgccctctcctgggagcgcacggtgtatacatgtatatagatgtgtatttataacccaattattgtaacaaattatttattagatatagacatccatatcttatctacatttcaagatagaagtactttggaaataggaagatactgtgtctgtttcacctttgagtctcccactgtgcctataatctgcactgacagacatgagatgttccataaaggtcaattaattaatgaatgaaatcatgagcaaatgatttttgaaatcattttttcttacatatttttgagaaatgtaagcatctttgtgttttcccatcaatatttttagaaagcttcatttttcaacagctctgattaataatataattgaaaagcaaagaagtctttttaaatatgtactgtataagtctgtgatacttttgatcccacagagagtcaattccatttagttcaattcagcaagtgttaagtgcctatgatgtcaaatgcctgtagtgtggcaacagaatgcttcatttcagtgggataatttgggatgaaaaacttctaaacacgtttcagctcctaagtctgacttcagcagtcacaaagcaattctcccatgtttagactatagccattcattcatttgttcaataaaactttattggacatctattagatatgatcatgactgctctggattagatctcttgaaaactgtgatacaaaagaagagattgtgcaaggtctttcccacttggaaagaaaagttaaatagataaagcacctgagtaagagtaagcactgagtaaaagacctgggtttaatttcccacctcattctgttgttaagtagtgaagtgagcttagcaagtcactccatagctctgggcctcaatttgttatctgtgtagtaagggcagtagactggatgatgtctaaagaatattagagattagaaagtcattgtcctggatggctcacaccagtcactggagttgcttggcaggaaggcataacagcattttgtacatctagagctctgtccctctcatggggcaagtgatggaagaatccagtggcaaagttaggtttagcaggaagtcctctcccaataccaggggtctgagtcccggtgccatgctttgtttacctctatcacttgcaaggatgaaaaagcatctctaggcctggcccaatgtatggaatctaattcatgggactagatattttattagcatttccagctgaatgagtgatttggggttggacaatgtgacagtgaatagatgacatattccttaactagtgagtatgaaactgcatagaaataagatttcacaatgttatgatattaatgtactttctaatattttacatgatccatatgaagacatataatttacagtttagggtagatgtacataggtaacaaaaataactggagactccttttggagaagtctgcaattggatcaattagcatacattcccttacaagtgactcaaaacccaactagcaaagacggaaattttaggaacatttattgtttacccagcaagatgtctgaagagggtggttccaggtgtcagggcctggatttgtgtctctgccattttcttgctttttcccagtcacaagataactaacacagctgcagatatcaaatcctcacatgactgatgactgtaactacagaaaggaagcaggggagatgaacagacctctccctttgtacctctctcctagtattagagagaaaaacacctttccagaagcttccccagctgacctctcctctgtctcagcagcaaagaaagtttgagaaagcagaaatctgtggttttcagcctctactttggaaggaagacaaattaaaagcaagttggggatgtctgtggataggctgccaaagtgcttaccagaatccatcccacaggccacccaccatctgtagatatctttcctctcccacagccactgtgggtggaatgctgtggcccattgtctgagagagaactccacaggatcatccagttactgtagctagcaccaaatcttgcacatctgggtgatttgtagtctccatgccatcacatctcggtgtagattcctacggtgtagcagttgataactaaaagaaaatgtgtctgcttcaaatgcaatgatgctgaagtttaatttacctttcattaaaacttgcaattggaaaaaagaatgataggaaacacaatcgtcactgtgggtttttttccccccacatatctagttttgttgatctagaataatgaggttgagagaggattaaactccttggttagcccatctggcagcctataatactgatctttgggaaaatgttcctcattcatgtcctctgtgacccacctgagacattagagaagacgctccccttagaaattgcacagcctttccagctcacttcgttttagatcaaggttttgggatcttgatattgtcttaggagttaaacagagctcaatggtcatagcctgttgttgaccagccttagagtctatctggtcatgcaattgcttcaaaatcttagtgggctttctgatatctttgcttcaagtcaatttctgcaactaatgtgtctgtttgggttctttaggaagcagaacactgagatggagttaggagtgtaagcaatttatttttaggtggtgacacttatgaaagctaaaagttaaggaggctggattggaaagggagaaccttcagactatgatgtaaatctcacacctgtcacaagagatggggtagaagtaggattgggcaggagaatcctcagactatgacacagatctggcagaagtctttgccaactcaacagggaactgcagagcaaagacagctcattaagagagctacacattgggcagaaatagcccggaccttggatgcctactgtacttgtcattatctagaagctgctcagaaacagtatgatttccactccaaagtggagcaggatcccaaaggaactggcggctgtcagctaaccactctcactgcaagttctttctcgaagggagatctgattagggcacctccatggtggccatggcccaggatctggtctggctgcttcatctgtctcccctctttataggcttaatggtggttgttctgaagcaattcagaataagaggttgggtgcagaggctctattttgatcagacctttgccagcagacttgccttctttgcctgtcgaagaatgatggatgaggggagtttgggaacttgggaatgttgtcagtcttatttcttgttatgtctatactcccctgcttctgactccagcatgtctccaaattatgaaactctcagttaattcagacctcacactactaacagagaacatctcagaagagttccttctctttcctccctcctgacagattttctctaatctgtgttcatcttcttcttgcaggactttgccaaaagcttcaagaagtagccaacataactcaacatccaaaatgtctcctgccatttcccttaacactacagcctcagctggcacgtgattggaatctcaaggcatgacaagcaagagtccaacgcaaatgtcttgccgccacccagcaagtgttacagacatccagcctattctagctggaccctcactgctctctgccctgccacctcaactcagccattctgtattttcagatattatctgtgctgctctatttactgcaactaaattcaaaggaatgtgtttggctacaagtaacagaggataggtcaataaaaaggattttatttagtctacaagaaatctggacaaaggtggttccagggtaagtttagcacttccatgacatcaaggcaccaggttgttatcttagccagtctctggccttcccctcatggccacaagatggctgccacagcttccagggttatcctcacctaacaacatccaaaggcagaaaggagggtcacagaagagtgttatctttgcatgcctccctcctgtgatcagagaagagaaatccttcccagaggcctactggcatagttctgttatactgccttcagttgcaaaggaagcttgtaacatgaatctctggcattttcattctttagagtgggaggaggacaaaggcggagagcgatttggagcacagccagacagcagcgtttgccatgggatcatgcctattgatcttagttttccaacctccaacttggaaatagataaaccatctgtcttcccttcctggggagtagcaggttatgaataaattatgctgccagagcccagagagtccttaaaacaaaatactgtcaatccaaggccctcatttcattaaatccatattagtttctattgctcatttgatggcatctgattgttctctgggatgggaggtattggcagaacaggaaaaagggagaaaattagcccaaatccaccttccccaccaccctcttcccccagtgctgaatagtcatgaggtccccaggtacttgttatttctggcgagctagtgagctgagtacacaagtccatggctgggggatagatatattccagaaaactctgtgctggagtgctggagagggctgttggagagaagacacattactgatggagcaaattcagccaccatgaggaagttgggacagtattggggggcactatgccttcattagcccctgaacctacatcttataaagctgctgatccacctttctgcacacattattctttttttaaaaatttattttaacaccaacgccacttgccaaataacagtattcttatctcacaataattttatcttcccaatttctgtaatctcaggattcttaaaagggttatgagaaaattcccttttgtttccagaagatgctgcctctggaagcaggcctggttgatggctgattgtagactcagaggtctaaaccagtcagagtgccttgaagaatcaaatgcagccacgtaatcattattgccatttctggcagaagccctttaaattggcccagccttactatgccaaagggctggggaagcaaatgcaaacaactacttgttcctctgtcctcatggactttcctctcaccatccctctcacagttcttgttttggtcttccctccttgggtcctcactgctttgccaacatgtctccactacatctctctgacaccagtttctgcttgctccctggtggctgggggcacacacacaggcctccactgaccacccaggcttctagagacctgactccttgggcctgctcaggttactcaagttcatcattacaagccaagaaaagaggttgtaattgtggatactgcctggaccttagaggtccagcttaacttgaactggcttcttcgggactttcctggatctggcttgcaacttttctagatcagggtcagttcctctgctaccctctcacattcctaacatctggctagtgctggtctggttcccagagatgggaacgatgcatgccctccatgccagggctgtcccaatgggctctctcctccacgggctgatggggcttctgtttgtgagcactgatctgactctggtttccaagaacacggaaagactctgcaatcaaaactcagctcagccccaatttcactcatttgaaaactgttaatcacaagatatttgtaccccagatgtcagctggggtccttttgacttttgagattcaaatgacattggcttcagagtatagtgaacaaaaatgtgagtcctacatatggctagccagttttcccagcaccatttattaaatagggaatcctttccccattgcttatttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgtctccagctttgttcttttggcttaggattgccttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttataagttggattcctaggtattttattctctttgaagcaattgtgaatgggagttcactcatgatttggctctctgtttgtctgttattggtgtataagaatgcttgtaatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccgtgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggccaactggatcccttccttacaccttatacaaaaatcaattcaagatggattaaagacttaaacgttagacctaaaaccataaaaaccctagaagaaaacctaggcattaccattcaggacatgggcatgggcaaggacttcatgtccaaaacaccaaaagcaatggcaacaaaagacaaaattgacaaatgggatctaattaaactaaagagcttctgcacagcaaaagaaactaccatcagagggaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaagaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacattcacacgtatgtttattgcagcattattcacaatagcaaagacttggaaccaacccaaatgtccaacaatgatagactggattaagaaaatgtggcacatatacactatggaatactatgcagccataaaaaatgatgatttcatgtcctttgtagggacatggatgaagttggaaatcataattctcagtaaactatcacaagaacaaaaaaacaaacaccgcatattctcactcataggtgggaattgaacaatgagatcacatggacacaggaaggggaatatcacactctggggactgttgtggggttgggggaggggggagggatagcattgggagatatacctaatgctagatgacgagttagtgggtgcagcacaccagcatggcacatgtatacatatgtaactaacctgcacattgtgcacatgtaccctaaaacttaaagtataataaaaaaaaatgtgagtcctagagtccatcagcccagatcctacattcgggtactcttcttaccgtgctctggtgcacgtgatttaatttctctgctttttgtctataaaatgggcataataatacctgtataagtttggggtgctgattcaataaactattgcaagtggagcattaagaacaatggcgagcatacaatgttaccattcgctctgccccatgaggaagaaagaccctgttggatgaacttacatttcttctagtaatctttggctctgagtttctgctgcagccaaaacagaccagtttcaggaactgtattgacatatcatgctctctgattcttttctgtattgtcaccccttgctcagtgccaccttgattccttcactcttccagatactttctgaccgataaagtcgggtatgcagaggcttcctgaagtattagggcaatgagaaaggatttatattgcggcattacacaacttagatttgaattgaagatatttagttcttttttcttttttgagatggagtctaacactgtcgcccaggctggagtgcaatggcactatctcagctcactgcaacctctgtctgctgggttcaagtaattctcctgcctcagcctcctgagtagctgggattacaggcgcttgccaccatgcccagctgattttttttttgtatttttagtagagacggggtttcattatgtcggccaggctggtctcaaaatcctgacgtcatgatccacccatctcagcctcccaaagtgctgggattacaggcgtgagccaccgcgcctggccagacgtttaggtcttaaaagtcctttgactccacagtccccagcctctagccctctcctcctctcttttctggttgtctttttccttaactttgcttatttctctgtctacttagaataaaattattaggggtttagcttctacaccaaaaattcctagtacagcactttcttgctcttttaaaaaaatttttttttgtttttatttattttgattttaattttttttaatatacttcaagttctgggatacatgtgcacaacgtgcaggtttgttacataggtatacatgtgccatggtggtttgctgcacccatcaaccggtcatctacattaaatatttctcctaatgctatccctgccctagcccccgaccccctgacaggccccagtgtgtgatgttcccctccctgtgtccatgtgttctcattgatcaattcccacttatgagtgagaacatgtggtgtttggttttctgttcctgtgtttgttgagaatgatggtttccagcttcatcgatgtccctgcaaaggacatgaattcatccttttttaaggctgtatagtattccatggtgtatatatgctacattttctttatccagtctatcattggtgggcatttgggttggttctaagtctttgctattgtgaatagtgctgcagtaaacatacgtgtgcatgtgtgtttatagtagaataatttataatcctttgggtatatacccagtaatgggattgctgggtcaaatggtagttctggttctagatccttgaggaattgccacactgtcttccacaatggttgaactaatttacattcccaccaacagtgtaaaagcattgctatttctccacatcctctccagaatctgttgttccttgactttttaatgattgccattctaactggtgtgagatggtatctcattgcagttttcatatgcatttctctaatgaccagtgatgatgagcttttgttcatatgtttgttggccgcataagtgtcttctttggagaagtgtctgttcatatccttttcccactttttgatggggttgtttatttttttcttgtaaatttgtttaagttccttgtagattctggatattagcccattgtcagatggatagattgcaaaaattttctcccattctgtaggttgcctgttcactctaatgatagtttcttttgctgtgcagaagctctttagtttaattagatcccatttgtcaatttttgcttttgttgccactgcttttggtgttttagtcctgaagtctttgcccatgcctgtgtcctgaacggaattatctaggttttcttctagggtttttatggttttaggtcttatgtttgtcttaattcatcttgagttgatttttgtatatggtgtaaggaaggggtctagtttctgttttctgcatatggctagccagttttcctaacactgtttattaaatagagaatcctttccccattgcttgtttttgtcaggtttgtcaaagatcacatgtttgtggacgtgcggcattatttatgaggcctctgttccgtttcattggtctatatatctgttttggtaccagtgccatgctgttttggttaccgtagcctggtagtatagtttgaagtcaggtagcatgattcctctagctttgttctttttgcttagaattgtcttggctatatggtctctttttggttctatatgaaatttaaagtagttttttctaattctgtgaagaaagccagtggtagcttgatggggatagcattgaatctataaattactttgggcagtgtggccattttcatgatattgcttcttcctatccatgaggatggaatgtttttccatttgtttgtgtcctctcttatttccttgagcagtggtttgtagttctccttgaagtggtccttcacatcccttgtaagttgcattcctaggtattttattctctttgtagcaattgtgaatggcagttcactcatgatttggctcttgtcttaaagatagttctagtcctgaaaggaactcaagttgcagctttttaaataacaaaaattctcctctatatatgttgatgatgataactaattatgacaatcaaatatttaaatggcactaataataaaatggcaactaccaactatcattagcatgtgttttacagcttagaaagtactttcaaattctttattgtctcatttgaatgaatttccttttcagtttatgcctggagtatttgcaaataagggctttgtaacagaggatggccacacatacacatgcacatgcacacacatgcagactcgtgtgtagcgctctgtttcatgtgatgctcatgtaaagctccctgagatagaaggcctctgtcaatccatagacaaagtcattggttcagtgtctattgatcctgggtcctgggctggtaaccctgacacaacaggccaccatgacgagacattacggccttactttcttagtagatatgtctatcgagtttctgaaaatacagaggatggatgggctcatcttcctctgggattattgggtcatttctcagcatgtctgaagccgaacaggagtgaggccctgatgaatcacagtcagcatgcacagttcaagcaggagaaagctgaaatttcaacaaagatttaagtacttccaagcacacagcctttcatctttaaggactaattcacagtgtgcattttatacatctttatagggtcatgttaccattcctggacccttatttcttggcaaattgggggtggagtgacatttataagtgaatgcattcagtggagagcttgccatgacatgtatttcattgggagaggccataaatattttttgcacacatctgtatatccatgtgatgcttcattttggaaagcaacaataacaactgcgtcattaagcaacagagaggctaatgcatcagctggcctagtaggaaagacaaacaaggatcatcttgtcaaatcaaaatggattgtgctttgccaccagctgcctgcttttttgtaggtcccacagttcaagggtttgaattgaacctgcagttgtaacttaggatattaccacatcaggcaactcaccagcatcctttctgccctccaaggtcccggccctgactgtgatgggaagttcctagatgtccacagtgtggaccaattattgcccaggccttttcaaagtgtccctaaatagctgctgaaatggaacacactcagacatgtccctaaggctcttggctactgtcatagcttttaacacactgcattgtaattgtcttgttgaggagaaaaatattttttcctctccatcttctgtttatggcagagttctctgttacaaacgacagattaacaagagaaaagcaaacatatttatttaatataagttttatgtgacacgggagccttcatagggaaatgaagacccaaataaacagttaaatttgaatgtttttgcagtcattttgatgaagagtggagcatcatggagaaatatgatagggcaacgagtgtgatctaatggtaacaaattggcagaacttagcaagcgctgtttattcagattcttctctgtgtccctttgccttcagagataaggatattcttttcctcctggtatagggagggtacctcccacatgaaagtcttatgacctgcttcagaggaatatcaagaaatccttcctaggttttatgacctgcttcaggaaagaagggcagaggaaggtgacagtgatcttcctgcttctgcagttttctcaaatttcttcagcttaaaatactgttaagtagtgtgtcctgaacaccactgtcaactggagaatcatggagtttgtaaattttgaaagaagagcttttattcttataaagagttgcagcctgcaggctggctgttccacaggttgagaagtgtagcctcccacagaaactgaaagcaggcacttcaagggagggaagaatgagacagaaatgtatgctgaatgggttagctaagtatatatattcaacaggttaaaagaggagctatgggccaggcacattggctcgcacctgtaatcccagcactttggtaggctgaggcgggtgggtcacctgaggtcaggagttcgagacaagcctggccaatgtggcaaaaccccatctctagtaaaaaaaaaatagaaaaattagccaggcttggtggcgggcacctgtaattccagctactcaggaggctgaggcaggagaactgcttgaacccaggaggcagaggttacagtgagctgagattgtgccattgcactccagcctgggtgacaagagcaaaactctgtctcaaaaaaaaaaaggtatgaatattcatgtaggggcatacatatgcatagtaagcaaacatccatccatcccatgtttgctttggggtggagccttaacatttaaatatattaaaattaggctttttacatcaaaaggtgaaatagaagacacagaagcacacagtgtgcagcctctgtaaaccagcctgaacaagtccacggtcagcagcctcttatcaggaaggaacgctggttgtttgttgtgttgaaaccacaaacaaggaggggagtctggcaagtctttcaaaagggcttagaaacccttggaaaagaaagtctaatggccattagtgggggagggggtatactgaggcatgtacgacctcccatcccatcatggctaggaactcagttttaaggttaccttggggttctcttggccaagaggtggtctgtttagttggttgatggagttaggattttatttttatttctcaccatcaatctgatcacatctcaatctccattattagatcaaaaactccatgaagacagagactatgtcctatttctatccatgtactcagcatctaatacaacacctggcatataataactaatcaataggtttgttgactgaataaatgaatagtcctgtcccaacagggcaaaggaattaattttttttttctgaatgaaattattcctctatgacaaagttcacctccttaaatttcctttggatcactttgtctcttgcattgcatgtaggtgatgaatattgagaacatttatacttcatttagtcattttctccccaaacagatatgacaatgaataattttatcataaaatcaaataaaaagtgaaagggaagtatattgggttggtagcatagaagaaaggatgcctgggattgccgtgaggctgggctcaatggagatgtatccttcagctaagaatgggtctcagccatctcctaggggctatgaaatgtggatggctgtgtttatcatgactagaaggaccttgtgtctcttaatgggtggggctcagggatgttaaacatcctgtaacattccagtcaaatctttatgatgaagaattttctgccttaatgccattaatattcaatataggaatcatcttttttttttttttttttttttgagatggaatctcactctgtcacccaggctggagtacagtgacgcgatctcggctcactgcaaccagcctcctcctcctgagttcaagtgattctactgtctcagcctcccgagtaactgggactacaggcacctgccaccatgcttggctaattttttgtatttttagtagagacggggtttcatcgtgttagccaggaaggtcttgatctcctgaccttgtgatccgccggactcgacctcccaaagtgctgggattacaggcgtgcgtcactggacccggcgggaatcatcttttatactttaagttagtttcacttcaggatatgccgtttgtttcctccctccaccttttttattcttttttccctttcttccttttcttccttatttcattcttttcttcccttcctccttccaaaacttactaaatatctactaagggaaatggatggtgatgcttacgaaaatgaatcagacataggcttggcctcagggattaaactcatgcaaggaaagatgtgacatttgtttaaaaataaagagaattgggcagaaagaaagtggagggaaagtaaaggtaaaatgttatagatcagaggagagagagatgtccctgatgttttaaatgaaatgcatcttataaatcaacatttcattatgttttgcagacctctatagtttacaaaggcctttcctatatgttctttcgtttacattaatacttactgtaacccaacaaaggtactttatttgccctcagatttattcctcactgtttctctgctctgctttgtattagcaggggccagaccttgcaaactatgcccccatccttattagctggctgccatctgggtttagctaataggaagcaatgggagatagagccttctcccttaagcagcaggtagctgctgcttctctggcggtccacttcctacgagaaaagccttttgtgtctggactccagaactctgcttcttcccttttctctcctgctgaggagtagtatagcttcctgttgttgaaatctctggtttactccaccattcccttatgactcttaaagtctccaccacctgagtaagcaatactttgtattaaattccctgggctgtaaatatctgaaagggattttgttttttaaattagatcctaagtagaaagaaagcactactcttaccactttagagataaggagaaagttaaacgactttcccaagttcaaccagcaataagaggcagagtccaggtctgtctcctgactccaaatccaggcttttatccactgcctcatactgcctcccttagagactataacaatgaaaacataatacaaataaagacttttccaagatcatataaaagacatatcagattgtagaattttgttttcccctgtgtgcctttaaattgagatgagcttcttttgtttttattgttcttgggaaaagttaatgtattagctagattaggagaatgtaacacaagtacatatggatattagcctgacatttgacaaagtcattcacgatagcctactggaacaatgcatgttggtacagtcacatggattagtaaatatttgatgcaaggttttaaaaagtccacatagtaccttatgctgtcatatctcataatatttctacgattatcattatgacctcaccttggaatgaggaaaagtaaaagtcatattgaaaatgttttcagtttagaaagctttcataaatatatgaatcagagatacatttgtccaggttaccataccctggctacaaggatattttaattatcaaatattactaaattagttactgaatgttaccaatcaccaaaataactaatttactaataattataaagccctattctctgaaaagaccttatggggatggaccaggatctgaagtaagggcttggggatatgggcctggcaaaaacaggaagtggagctctgtgagaaggctcagtttggaggggctgcttgttcagattttgctatgatttgaatcctattctttctcctggagaacaagaaactaagaatgggaatccagaagcatcaggtcacattccaagagtggttacttacaccacatctgtcatcagccaaatctattctgccttgaaacagaggagagaaataagaggaggggcatttgagccttatttcataaagtgcatggtgttgaatgctaaattatccatgtctttgaagggctgagtttgaatgagttcacatatacatcccagtgattctcaactgtggatcctagataacatttggaaaattgcagggttgtttttgttagaaataatcgctacaggtggttcagtacatgttagttgttacgacagttccatacaacaaagaattatcctaaaattatcacacctacctcctaggtgctacgtatggtactctgttaggattgtctgattaattccatgaaggtctatactcctggggtgagggctgtggctggggtctcccctgaaaaagaaggacttcctaagtgtcgcttttctggagaagaggtgatttattaggtaaaactcccagaattatttggtgcaaaacatccaagaatgtttctgcttggaacagatgtaggcccacatacaaaagagggtcaacgtgagatcatattagagaagctggacttatgaccaattcctttgggcggtggaagtaataagttgacctatttcatctaactccactaatgtccacattgttaggttgggggaatgcgtgagtcttcctttgatgggtgtctcttaggggctgaagcagcctccaatgtccaggtggtgatggcagtgatgtaaatgaaagagctgcaaaggaaggcaaatccagagaggaaaagaaaacaactgcaaaggtcattcatctcttctcatttggggaggagtctcctcccattgcctactttttttttttttttttttttgaaacagagtcttgctgttgcccagcctagagtgtgatggtgcaacttctgcctcccaggttcaagtgattctccagcctcagcctcctgtgtaggtgggattacagatgcatgccaccacacttggctaatttttgtatttttagtagagacgaggttttaccatgttggccaggctggtctcaaactcttgacttcaagtgatccacccgcatcggcctcccaaagtgctgggattacaggtgtgagccactgcgcccagaccattgccaactttggaagattgaagtgttattatggtatggctagatgttcatcagtcctatttcctcttcctgggcacatagacaaaatttccagcacttggtttggagccatatgactggtacggctcataggatgtggttgaaatgatatatgacacttccagacctggcccttaaaatctcctgtgagattcttgactctctctctgttccctatcttcatgtacggtggagccattctatgggaacaacccagtttcctagatactggttaaagcaaaactgtctagaggagtcacaaccaacactggactgatacatgattgcaaattaaacttctgttgcattaagttactgagatttgagggtttatttgttacaacagcatagcctagtttatgtaccacaagtttgaaagggcattaatcaataaactgtggctgattcctggagaaaagtgtatagtggtatatgacaaggctctgctttctgcctgttaatgacctgggtgagaacactggtagaatactgatcaaattggaaactgataggaaacaggaaggaatacttcgtgtatctggtaataacataagaatatttctaaaaataactagaagattttaaacactgaaccaaatcaaatacatttctgtagggctaaatggaaactactacacttatatccaaaaagcctatcttacaagtatagaatagacgatatgtgaaaaatgacttcaaggcttaaagtgacagtaaggtcaatatgagctaacatgttgcagttatgtgatataatcttcagctgcattaatataaatatgaagtctgaaactgtagatagtaacattattctattttttagtgattgaaccaatactgtgctctctaaatgcttcagtttaaactttaggactatccctgtaggaaaaaaaatagtcaccattattgtaggagcttgaattaatggtatgaggaataatcaaaagaactggacaggtttactttggagaaaacttacttaaagggaccttgataatcactgaaaatacattttattgatatacttcacataccattacactcgctcttttaaattatacaattcaaattttttttatatattcacaactagatagatcaccactatctaatttcagaatatttgcatcatccaaaaagaaaccctatgtacgttagcagttacttcctacttccctctccccatagtttctggtaattgcaaatctgctttaggtctctatatatttgtctattctgagaatttcatacaaagggaatcatgtaatacgtggtattatatgtctcacttctatcagtgagcataatgttttgaagattcacccattttgtagaatgtatcagtacttcattcttttttatggttgaaaaatattgcattatatggatataaaacattttgtttatccattcatcagttgatgaatatttgggttgtgtccaccttttggctataggaataagtcttccatgaacaatgcttctattaacacacattttaaaaaaattttaagttctggaatacatgtgcagaacgtgcaggtttgttagatagctatacatgtgccacggtggtttgctgcaccttttgacctgtcctctaagttccctctccttgccccccaccctgcaacaggccccagtgtgtattgttcccctccctgtgtccatgtgttctcattgttcaactcccacttatgagtgagaacattaacgcacaattttttatgtgacatatgtttttagttcttttgagtattgatatgatttggctgtgtgtccccagccaaatctcatcttcaattgtaatccccacatgttgagggaaggacctggtgggaggtgactggatcatggtagcagtatccctccatactgttctcaagatagcaaggtacttctcacaaggtctgatggttttaaaagtgacaggttgtttttttttcttgttctgctctctctctctcttctgtcaccatgtaagatgtgccttgcctccccttggccttccaccatgattgtaagtttcctgaggcctccccagctatgcagaactgtgagtcaattaaacttcttttgtttagaaattacccagtctcaggtagtatctttatagcaatgtgaaaatggactaatacaggtatatacttaggaatggaaatgctgggtcatgtggcaactccatttaactttttgaggaactgcccaactgatttacacatcagctgtactgttttacattcccaccaacaatgacaacagtttcagtttctccacaaactgtctaacacttgctatcatctgtattttttattagaaccatcctagtggatgtgaagtggtatcttattccgacttgatttgcatttctctaatgattaatgatgttgagcaccttttcatgtatttattcccatttgtatatcattttttgagaaatatctattcagattatttcccaatttttattgggttatttgtctttttattatcgagtaatacttcttttaatattctggatactagaccctgatcagacatataatttgaaaatactctatcccattttgtggcttctttcaatttcttgatagtgtcttttgatacataaattttttttaattttgaagtccaatgttattttttctttggtttcttatactttacgtgtcatctctaggaaatcattgcctaatgcaaggctgtggaagatttaacctaagctatcttcattgtccataatttaagtctttgatgcattttgagtaaacttatgtttgagtaaatatattttgagtaaaaatatggtataaggtacacacccaactttatctttttgcatgtacatattcagttcactatttgttgaaaagactattctttaatttatttacatcctgatgtattatgtcctttcttctgcttgctttgggtttaatttactattctttgtctagtttcttaaggaaaaagattaggtgattgattcagaatcttatttcttttttaaaatacaaatacttacagctgtaaatttcctcctaagcactgctttcatagcctcccttaagttttggtatgttgtgtttttattttcatgcaactcaaattaatgtctcatgttttattttttaacccattggttattgagaagtgtattgtttaatttctagatatttataaatattataaatttccctctgttactgatttctaatttcattccattatggtcagagaatatactttgtatgatttcaatcctttaaaaatacattgaaacttattgtatgtcctaacatgtgttctatctcagagaatgttctatgtgtacttgcaaagagtttttattctgctacttttgggtggaatattctacagatgtctgttagctcctgctggcttacagagctgttcgtgacttctgtttccttcttgatcttctgtctagttgttctgtctattattaaaagtgaagtgttgaagtctccagctattattgttgagctgtctatttcttcaattctgtcagcatttactcttatgtattttggtgctctgttattaggtgcataggtgcaaaaattttgttttgtattgcattgaattgatacatcaatttagataaattgtcatcttggcaatattgactcaatatgtgtatataagggtacttcaaaacatttgtggaaaaaatgaaattcaaagataaaaagtataaactttatttccaatataagctccatcaagttcaagatatctttataagttatggtatcagtcatttagctcatccctaaagaattgagggtcttgggaatttaatcatgtcaatgcagtcattttttgtaatattaactgaagaatggtaggtgccctttaaagatattttaagataagaaaaaaaaaaaaaccagaaaaatgtcagaaggagccaaatcaggtctgtaaggtggattcctaatgatttcctgtagaaattttcacaaaattgtccttgtttgataagaagataggagcattatcgtggtggagaagaactctggtgaagctttctcaggcatttttctactaaagctttggtaactttctcaaaatactctcatcataaggagatattattgttctttggaccttgggcaacccaaaaaactgttgccatgacctttgctcttggccagtctgctttggctttgactgaaccacttccactttttggtagccatagctttcattgtgctttgtcttcaggatcatactggtaaagtcacatttcatctcctgttacaattctgaaaagaaatgcttcaggatcttgatctcagttgttttaaaattttcgttgaaagctctgctcttgtctgcagctaatttaggcacaatggttttggcacttattaagtggaaagtttgttcaactttattcttttagtcaggattgtgtaagctgaaccaattgagatgtctatggtattgactattgtttctgctcttgttggtcttcttcgattagagtgcaaacaagataaattatttccctgaaagaagctcttttcaaactgacgtcttatacttcttagtgcatcaaataggattcggttcagacatgttataactagtacaagtttatttttgtgcaaaaagattttgaaatccattcatagttttttcataatacacattttccatgaactttgtgaagaccccttgtatggtatatctctccacttatttagatattttctaacttatctcagtaatgttttattgtttcctatgtaaaggttttacatatatatttttagatttttttcatatttattacaaatgggatgttattgcaaatggaatctctttaaaagttttattttcctttttttctagtacaaagatatataattggtatatttaccctgaaactagtacttataaatcataaattttagtagctttaggttactttgaactttgtacatatataatcttaccttctagaataaaaagaaaaaagcaaccagttgttttattttttcctctccaactcttaaatatttatttattattctggctgcattgtactggctataatctttattacaatatgaatataagtggtgatgtcaagagtccttgattcatttcaaagctcagagcaaaatctttcaacaatttaccattagctgtgaggattgttgtaggtttggataggtattctttaatagatacaggatattcctttctattctttgtgaacaaagaggtttttgttttgttatttttgatttttttgtttttgttctcccctatctgactgtcatttatttctacaactcctcgagagaagtagtcataagtggcctgttccatcttcataacagagaagggcataggatacttaaagcctacctattcaaagcatgaattacaatatattccacaatgaaaaagtgatgactatctcaatttcgaagttgattgttaagcaacacaggcttttaaaataaaacaagagcccattccaggggttgcaaacgggtgaccagtagggtaaatctggctgtagatggttttatctggtccacagtagttttaagcttttgttttttcttaattcttcaccagggatacaaaaattttacatttacatctgtgatttctgccttctcttttttaaaaaagttggtaatgggccttaatgcaaaatcggctggagaataaagatcccttttttacaagacgtgttcttaaatttgccactgatagtcacatatcaaatttctccttctaattttgttgtatagttttgaatctgggcagactatctgcaatttggtgaaaatgttgtttagtatgtaaataaacaaaaacacctaaattttacatggttatagaatgctgaataatataaattgaacgaaaacagaaaagatgaattaaaggacggggggtggggggaagtttgaacttaaagattccaaagcaagtgagaccatggtacatagtttagaaaatgttatatatgtacaacataaggtggactctgaggctaactttaggaaaacattagtaatttgtgagggaaactgacagactacaaaggttgtttcctttatcttcctaacctatcaatatcccactttgatattaattcaaaatgtttaatgaaatgacttctctgatagttaagaaaatttacatattaaaacacttatttctgaggatacagtctatcatttgaatgagaagacccaaagaatgccttactaaacagtaaactgcctttaagtatatcatctgtgatcaattcagtaagactaagtttattacacttcaattccaggcataaaatgactatctggtaaactacaaagagctccttacaaaagaagtccatataattacagatattgtagaattccaggctcttctctgaaaaatgcaaaggaatcgatgttcgagtactacggtaatccacatctttctcaggtcagactataccatatactgcagaaatgtttaatcaattttggcagctcaggccatgaagccccaccacaacatcctgaactgttacagtctaactcttgggtcgctgttaagaactgtaggatcttcaaggctttctgggaagctttgctcagtttgcaaatcacataaaagggaagagttgcctcttcctgtttgcctggcttcccttctgggattgcttctcttatcagtttcaggctctttggtatttctctattttaaagatttcaaagggatgtgtagggcatgagtcaaatgacacatatccaccaccatttgaggcctgatgtcccccgtaaggttggttgtctcagaatccagaagtggcttatagtctgtgatagaaatccaatcctcagcaactgcagggagcagcactgaggacccacagaaggccttgtagtcttccagatctgtcactgtgggcaggccccacaagcacactgcaactgtatactatggaaataccctatgaacacatctaagagtgagaggtgaagccagttggacttctaggttgggtggggacttggataacttttctatcttacaggaggattgtaaaatgcaccaatcagcactctgtagttaggattgtaaaacgtgccaatcagcgctctgtggctagctagaggtttgtaaaatgagccaatcagtgctctgcggctagctagaggtttgtaaaatggaccaatcagcactctgtgaaatggaccaatcagcacactgcaaaatggaccaatcagatctctgtaaaatggaccaatcagcaggaggtgggccgggacaaataagggaataaaagctggccgcccacaacaagccaacagcaacccactagtccctttccaggctgtggtagctttgttctctcgctctttacagtaaatcttgctgctggtcactctttgggtccgtgccacctttcagagctgtaacactcacaggggaggtccacttcttcattcttgaagtcagctagaccatgaaccggcaggaaggaaccaattagggcacaagagcaacaggctgctactgcaaagaggcccaaacagcagagatctcagcacttccagcatccgcaggcaaccctacatgttgacccctgtctcactgccaccccctgatgttccccccacccacgctccatctgcccggttggaagtggtttgggggaagaggaagggatagcaagtggtagactatcacgtggtcccccaagcacaggagaggttggccagcatttattaaccacgtggtgaacggcatgttgtctgaacagtcaccatcaggtcctagcagcaggccagatcagcgcagtgtcgtgagggcccggacttagggaacgcatccatggccaaggtgaggtagcagaagcagaaaaggccaaggcccagcaggccagccagcccctcaaactgcagcccgcactgctggtacatagtcgttgtgtgcaaacttcagccatgccagcgcaggcagcactagctgttggctgagcgcagtctcgacttggtggccttcggaagaccgaaccaggggctcgggctcaggctctggctcgtgctttaacagaagcctccaccggtgtctgcttccgcgaactgagctcctcctcctgctgggcaacttcagttgcaagatgagtgtctcctccctagaggccatggtttggaagtcattttcaatacaatgatttcaatacatacattcaacacatacatttcattcaatacattgatttttgaatgtgaaatccaactttttttcttaaacccaaattgttcatggtgtgttatcatttttgtagtttgctatatttgatttactaaaattttgtatatcatttattgcatctgtgtaaatgagagagctggagctctagttttattgtaatgtcactggcaaattttggtttcagtgttatgctgtcctcataaaatgatttggtgagtattgtctcttttaatactttacagaatttgtctattttatgtaattttttccataaatatttcatggaagtcactggtgaattctggatctagaattttcattaagggaaggtttcaatagatacagaactattttgagtttgcatttcgttttgataagttgcactttccttagggtttatttcatctaaaattttaaattaatcggcccaaagttgttcacaatgatctcttatgagctttctaatgtctaatgggacctgtaataatgtacgctttctcagccctaattttagttgtgtgagcgctctctatagaaactcacacccctgaccagggctcatttttttgggctggccagctccagccctgggccaactctagccttgtgtctgtttttataaaataaagttttgttgggacacaatcatacttattcatttgtatattatctatagcagcaccacaatgccagagatgaggagtttcacagagaccgtaaagtctgcaaagaccaaaaaaaaaaaaaaaaaaaaaattttttttatctggtcctttacagaagaagttattttattcctgatctaggctattagtctactgaatgaaccaactttttgtcttagtttctcctctcctatgtttatttcagtaatatcttttattttttatttaaatttaatttgctttttaaaaacttcttgaaatagtttctcagataaattgatttccagttcttcttgactggcttattaagccataaatttccctctaaataaggctttgactgtgattcataagctttgatatattttcattatcatttagttcaaaatattttctaatttgcattataattttttatttgaatcttgggttatttagcattggatttcttaatttccagatatattttctagttattgtttgtttttaatttctaggtgaattttagagtcccctgggaatacagcatgtatgattttttttttttctttgaaatttttgagacctgccccattctccaacatatggtcaattttggtaaatattctgtgtgcacttgaaaaaaatgtgcattctgaaattgtgttcagtgttctaaatatgtcaattaggccacgttttgtaatcctgttgcactaatctgtatccttactgatgtattgtttgcttgttctatctgttattgagagagttatgttataatctctcattgtaattgtgaattttttacatgtccttttacttctgttattttggctttacatatttttcatacaaatatgggttaggtacatataacttcagaattgtatgtgatcctggtggattaaccattttatcttgtgaaacatccttatttatctctggtaattaaccctgcctcaatgtttattttcctgatatttaataaattgtagcagctaattctttgctcaaaattccaatgtcctatctcttccttctttttttatctgaccaatggattcacacatcacacaattctttactttcaatatttaaatgctcttataattagtacctgtttcctatcagcaatatatggctgatttttattaagtctaatctaccagtctttatatttcattttcagtatttagtatagatttatgtatttactgatatattttagtaaaggctatttttcccacttgttatctttctttttctaatctttattgactcttttgaattatttctcataattcaaatgttctctgttaatatttatgttattttagtagttatcttaaattactgactttttagaaaataaaacaatgcctttacctctcccagacaatgtaaggactttaaatctattccctctccatcaacttacgtgatattgttgtcatgtgtgttgattctatataaattttaaatcctagaggatgcgattgtgttatagagtcagtattcttttacatttacccatattgtcactagttctattggttgttactccttttggcatctccttgcttcattgagaagtcatctttcttcaacttaaagaatacgtcagtattggctgggtgcggtggctcacacctgtaatcccagcaatttgggaggccacggtgggcagatcacctgaggtcaggagttcgagaccagcctgcctgcccaatgtggcgaaacctcgtctctactaaaagtacaaaaattagctgggcatgatggcgggcgcctgtaatcccagctacttaggaggcagaggcaggagaattgcttgaacccgggaggtagaagttgcagtgcactaagatcttgccactacactccagcctgggcgataagagcgagactccatctcaaaaaaaaaaaaaaaaaaaaaaaaaaaaggatttcctttagtgtgaagcttctgtggtggttttttttccttagctttgtttgactgaaaaatgtctttatcttcttttttttttttttttataatgagactttatcttcctgcctttctaatttcctcctggtttttattttcaaaattttaagtgtgatattttctaggtgtgatttccttctatgtatctttcttgtggctaatggagcttggttagtatcctttttctgttggaacattgagggtcatcgttatttcttcagctgttacttttgctctattttctctccctggaactcccattataggtctgtcagacttttcaccatgtcccatttaattcttaagtttttttcctgtattttccatctttttgtccctttgtgtcaatcaatacattttattttggcctatattccagtttactaaacatctttttaatagtatctttttcctttcttttctttttttttagagacagggtctcactctatcacccaggctggagtgcaatggtgtgatcatagctcactgtaacctcgaactattgggcccaagtgttcctcctgcctcagcctctcaagtagctgggacaagaggcgtgcaccttgaactgtacctaattggcttttaaatctatccatttggaatcatgctatgaggatttttttaaaacagctttattgagacattaattcacacaccatacaattcacccatttaaagtgtataattcagtggcttttagtatatttacatggttgtgtatccatcaccacatttcttttttacatttagaacattattagaacatttttattacctggaaaagaaaccctgacctcttagtcatcaccacttaacctcccatcatgcccacctctgggcaaccactagtctgctttctgtctctatagatttgcttgtttttgacattttatataaatgaaatcatgcagtatgtggtattttgtggctggtttctttcacttagcatagttttcaaggtggatccatgttgtaccatgtagcagtcttcatttgtttttatttctgaataacaatgtatacatgtaccatattttatttattcatctgttgatggatatttatgttgtttccatctattgagttttatatttcactgatagttttcagctttagaatgtaatttgattattttttatattttctggttctaactcttgtcagaacttcttgttaatttattgaacatatctagctgtgtcttacagctacagtatctggattgtttttgttgtcgctgctctgtttctgtttctttttctctcttttttttctctttagccttgcttttttgtatacctatttattctttattgaactcttcagatatttttcatgaaaaatggcagagataatttgtggctctggattatgctatcccctccagagaggatttactttgtttctggcaggcatttaggcaaggaagttgatgaccttaatccaatcaagcttgacttaagtgtgaggtgtggtctgttgctggttcacccacgcattttaggcctccaatcctgaaagcccagggtgcttaccagggccccttcttcttagtgatttccaagttttgactgttaaatctggagctgttaaaagcccttctctgtttctcagactcttagctgccaccttgactttgaacatcagtaacagctgtaagtatcaacgtgactctgaattgtgggtttacatttttttggttttctcctcttccatatctttgcctcacaagtcttactttcttgataggtctcatgtctttaaaaatatttttaaaatatatattatcctgcttctctggttattctcagccagaaggcttctttgaaactatctagttggccgatgctggaaacagaagtctacccacgaatttgttaagaatcatttctttcaaggatatggtaaagcaagcattcttacacatggctgattagagtataatctagttcacctctctaaaaagcagtgtttcagttagcccatggccttaaacacattataccctttgactcagccattctaattctgtgagcaaatcagaaataaattattagagaggcagaaaatatatttacatacaaggatattcactaaaactcttaatagagaaaactggatgtcaactaaatattcaatgataaggatgataattatggtacatctatgagatagaatagtctgtggtgattcaaaatcatgtattgaaaaatatttattgatatagaagaataagatataaagaggaaaatgatacatacttttcatgtagcatgattccaatttttaaaaaagttacatgtttagggaaaatgctggaaagatacaaaccaatttttaatgaacttaatgttagatggtgagattaagggtttttaaacattttcttctttatatatttttgtattttcaaaggtttttaatattgagtgtgtactatttttataatgaagaaaaagtcacaaaaaaaccctaaactcacttttaatctggcagattatattccattcttttaatacagactttagcaagctagaaattctttacatttttaaagtcttagaaattaagacaaagacacttgcagaaaaccacatgggatgttgctggagagatgacagtgagcatcttcatcatgctccagggagcagttggctgcatgactctagttgttgtttcaatagttgacagaggtttcagcctttgtagacttggtggtcttcagactcttactgattgaaaaaatacttctctacaaaagtacaacagattttggagtctttttcattgtgaaagtcatatatccaaccagattttattagctacagtttttgttttcaaaacctctgggtgttattagggaaattctcttcttgaaattcaaaattgattttccagctggacgcagtggctcatgcctgtaatcccagcactttgggaagctgaggcggacggatcacttgaggccaagagtttgagaccagcctggctaacatggtgaaatcccatctctaccaaaacattagctaggcatggaggtgtgtgcctgtggtcccagctacttgggaggcggaggcaagagaattgctcgaacctgggaggcggaggttgcagtgagccaagattgcgctgctgcactccagcctgggtgacaaagtgagactttgtctccaaaaaggaaaaaaaaaaaccaaaaaacaaaacgcttcaaatccattttcataagaaccaatttttcccactgttctttacagaacaggtcatttatgaagggatcttatcttggaagagggagggtaagaagagacagtttggttatttgactgattacatagcaactccatatgggatgttttatttcacattcttgagttaatccttaactaatttctcatatctgacctctgttttctttgaaatgttggtgaacatgtcaaacattcttcccacccacctcgacactttactttcttccccagcttggtttcagataactggcaaccttatgatgtttattgcttcagatatggacagtttaggaactatccaaagtttctcattgctcatctgtaataatacttttcatgatggcactagaatcctaaattctggtctgattcaggaagatggtctattttcatatttaaattggcctgaaaaaagtaaggccttgttgatacaggtaggggtccactaccctgaaatgttgctcaaaagcacatttcaattttattcaaaagctgctttgatgtgtattcccccaaagcaccttagctgaaaatcaaattttattttagagctttgtacagaccaatgtctctttctagcttcctgtacaccaataaaattgtgtatttcaatttaacctcaatctgcctgtgtttaaaatataaagctaaggttaagggctttcactgctagcaaccctacctggacatctctatttctagataaaaccttttactgagaacattttattagtcctgcagctcaacgctgccatatatgccagcctgtcctattaatccttagctacaaaaatatcagaatcatttatgagctaaagttttttttttttttttagctttttaattttctgagcctttgtggtattatttgggtcagtttggttgctggggctccacctcttcccacctgcccccaacccagtgtctctgagttggggagaagagtctcaggaccatggggaccaagaggctttagggctgaccacctactgtaactggctgtctcatgctggccccttggcctgatttgggatgcgagatgccccatcactttccttttgtgttgttcctcaagtcctggaatcccacagtagctcaccttgtttttaccacccttttctcttctttggggcctactgcactatttccaaattttatagtgtgtttagtgggaagagctgggagaaatggctctgcaccattttgtatagactagctctttttagctatataaaaggtttcttctattcagacttctcctcttgttcataaaatgacactctaccttcagagaccacatgtgattttaatgccaggattccaaggcttgttctctgtcatatacaaaaacaatgattaggttgaagtggtacagaaccttgaaatactctctggaccagttctccagctgagactcaggatcacctaggacccagttccagacatcatactcatacttcaatgtcatactcaaatgagcttggcagaaatgcataaatgtgttagaattagggcctgaggaaccactgtcatgcttctttctgccctttcatggttaacaaaaacagactgactgctgagccagggatctttgtttcttggaagattttgcctcacctaacagaagcttaggtgggttcttgcctcctaacagaagcttggctgtgtccacatttttattcatcaaagcaggggtctccagtgaagtgtggacgtcaccaatgggctttaggaatgtttggtggctcctggagaactggtagaacagactggaaacctgagtgtctcctggaaaacaacttcagccacatccactgctggagttcagacagaggcatatgctgttcttgactcttctctttcatttaccttccatatgtaagacatccacaaatctgttaccaccatcttccaatatatccagaatccaataacttctcatcagctcccttactacctccctgacaagccaccatccactctcagtggactactgcactagcccactagctcatctttcctcccctgtatctcccctaccccagaaatgcaagtcagatgatgaaactcatctgtttaaatccatccaatgttttccatctcattcagggtcaaatgcaaagttcttcagtggcctatagtgcctggcatgatctagccctgatactttactagtttcatttgcttcttctctcctccttgctcatttctctccagcaatgtcagtccttaaacgtaccaagcactcccccacttcagcacccttatccttgaatcccccaaccgcaatgttcttcccccacacatctgcatggctcactcttcacctgctcagatagcaaccctgtcaggttttgcagaccactctgtaaaatttgttctctactcttgggttgctcttaatccccttatcctgctctatttttcttcatggcacttggcatcacccaacatagatatgtatctgtttgcctctttgccccttatggaaatgagagataggactttaatgcattccttctgtgtatccagaacctagaacagagcttggcatgtgatgggcttccactgtttaatgaataaatgaaggagtaaatgaatcaagataacctcgtacatctcttcaaggtggaactggaaagcctcccagaggaactcgtcagaaagaaataaggcctacaagagttttaaccagtaaccgagaaaggtaattctgaaaacagtataatgactgtctttaggcccaatgcccactggacacatgtctggtctttggaaaacaataaggttgtaaataagatcagaaagattcatttacctgaactataaaatatgagtgcggaaacgacactgctgtgggagtgttgttcttccccttttgccaggcattagttttctatcctgtgtaacacaataccagacatcatcattatgtcacagttctgtaggtcagaagtccaggcagccttggccgtgttctctgcttagggtctcatgcagctgatgttagggtcttggttgagctggactcttatctggaggttctggggaaaaatctgctatcgagctcattcaggttgtggcagaattaagttccttgcagttgcagggctgagggtcccatgttttttctggctgtcatctgggagccactttcagcttctagaggcacctgcatttctccctacgttgcccatccatcttcaagcaagcaacagcacctcaaatccttcttgtgctttgaatctctctgccttctctctctaccattagctggcgaaaactctgcttttaaagagttccttaggtttatgttggacccacccggataatctttcttttgcaaataaggtagcataatcacagaagtgatagctcatcatatttacagattccacttacactcagaaggacccacactgtgagtcattcttagaagtccaccacacatcacgatccagctaggcactaagagggttcctgggatcagagtgatacctgatggaggagcagtggtccccactgtacctgcaagaccattagtgggggactgttttgccatggggcatattgaagagaaatgggctacttctgggagtggcagcaagatcctttaagcctgataggctagaggcacttgcaggaatagacctgtttatgcgcctatgatgatgactttatagagacctatagaaagacttgcaaagaatttccaaaggttaagtgatcctgcaaggccacagatgaatcaaatgtgagttattactgttcgagtgaccatgtttgtgtgcatacagtagtgaggactggaaaaatgttccccaggtcagagcagatgttagtgacttaatctaatgaagtcctgaagatctgaaggaccaatgacccttctatgtccttgtcctttcaatttcaagattctaaacctggtaaatagctaagccagtattcaaccacaggttgtcaagctcaaaagcccatgaattttctcaagaactctgccagggatgggaaatgggtggcatgcttaccatgacgcagcactcctgtgccctatcactgaccactcaccaccttcctgcagcctaggaatcatcacgactgctgtcgactaccactggcaattaaatcagagttgaaatccagggcagaacttaactcccatccctggagaccacactgtatctcaaattccagcaatgccagaaccagaaagatttccgccaatttcttactcagctgcaaaatcatatattgtaaatgttagaggaataccttgactctctctattgtgtacctttagttgaatctgactaggggaagggaagttaaaataactgaaatcttttatacatttttggactattaaacttataattctgggattttcctctcctagcttttcttttttttttttttctaagtatttcactgattaaaatgaatgagaaaggaattaaaatgaataaatggcaggaatgtagacccaaagaggatacactaaagccatttgtgctatttaaacttcttagagggaactgatgttaacattaagaggctgtgctctgttcccacagagaagtagccttaggcaagctgtcaggaagctcaagttgatggaagttactggaagctctgagaggcggagggggagggggttggggggcatctcttggatggtgcagcagctgtatttggaactgggaaggtagggaaggggctactggagtgtcatgtagtcctatattttgaaatgcaaagttatcttctttgtattgatatttctaggatgcattcacatgatgcagccatctcacactaaagatcagatacttctttccagatatttcttgttcagacaaccgagacaaaaagaaaaaccatacttgagcctcaaagacagcaaacggaggttactcttaaattggccttataagcccgtgatctaacccctacctactccaccatcacttctcaggatctgggcggaagcctcactggcctcaaggttttcggtgtggctgttctccctttggcctgctcttgcctacctctttgtcagactaactcctatttagtggtgcatgatagacacatctgatagcaataactcaacgtaagcataccctgagaatgaccctgagaatggcccttatggcagacacatctgaatgtggttttcaagctcgggaatctgggagcggccaacctggagattcattccttatctatgaggaacacctgagcccccagcccgttttccccccaccgccccggaacctgggtcagacagtggatctaggccctttgtgttgggttaaattaaggttgccaggtgggggttgttgggagagggtgctaagtgaaggtgctgtacaaactgcatgctttttaacaagcaacggtggttctcttgtctagcctgctgtcactgcaccatctctttgggtaagtttcccactgataaaaccctgtgtcttgtttgctggttctgggactcttccttggcttcttgaacttggtgttgtccctactgaagtgaatagggatccaacatgacaagttctcttgtcttaatttaggtgcatgccttgtggggctcttctctgccttgcaaaccttatcagatgccccagttacacacttgcctagagccttgtactttgcctcagtcacacttgtggttactgctcagtaatgcttattgaataattaatttattgtgtgctgtagttctttttataaatgagattgtcaatttcttgaggccgggaattaagtctctttcgttcactgctgtatctgcaaaacctcgctcggtatttaatactcagcaagggcttggcaaatatgtgttgaatgaattaccgtgagaaacaaaaaaactagaaccctggagcactggctatgataaaaacatgcagcaggtgggttttgttttcaaggcacttcttcctctggtagcatctctcttcctgcatacatccacacatgccaggctcatgttcatagggcttagctcccagttgactgttaggtatttcctcaactaacgaactgagttgacaatgaccagggctgttttgagctatatttggagaattttaaacaacagagatgtttctaaactttcagctgcttggaagattttaaattggtaaccaaggtagtgatctaggagatgtcatgtgctataaggagattctcccccatactattaaaggaatctccaaaatgaggccgcatagcagatgggggtaggtgggagggaaatttttgtggcagtggtgatgcaggtggagtgaattagatcagctgtttttgtttttaacagaaaattgtgatggttgaaactgtctgacaagacagctggcatttttattaaagccttcagcaactacacacctcaataatatgaggaggggccctgcctggttgattggtaggtggatggttaattggttgttttcttctggtcaagcttgactttctaaatgtgtaataaagtcataagacttccatgcgtttgcccgaaatgagcttttctggtcagaattaactatgtgtaggctggtgctcccagagtggttggtagacattttatttggttttgtgctcccccaacagggagtagcccttttaggacaggaagcccatttcccagatctgtgtccagagcctcaagcccagtgcatcacgagtcactccttaagacggatgtgttgatttaaacccaaacgaatgttttagaggagccgcctggcctggcctctctcactaccaagcgttggttggccagggagaaacaagtctgaggtgtctggtgtgcgtgcgcatgcgcgccctttctccttttttccttccgagtttttctctcctctctcctgcctttctttctcttctttcttcctccttgtctctatctcagtttctgtttctgagtgattcttgtctgtttctctcccttttcctccattctctgtgacatgaagggtttataagttgttaagtgcacaagcaacccttggcaagaggagaaaagagggcagaaatccagctacactatactggctgaggcataagtgctggcatgggattttgtctgcccagagaaggcatctttttctaatgtacacaaaagtgttttgggggctaacagcggccctttctttccctagaatattaccagggaaaacagtcattttctactttcctctggatccgggcttcctcgtatctcaaaaaacccgtcattaccctccttctctcatctgctgaccaaacctgggcaggttggaattgcatttctattggaaacgtattattaaaaaagtgttttgcagtatttagggcttgtgtctttttttctgcttatcttttatttttgttgggctcttttgagtagaagagctaaacttttaatcattttccttagatgtttccctctaattttctcttcccaattgtctatataactaaaccctcctaagctcttgttgatcctctggcagtgaaggtgtgtttatataacagtggtgtttgttccataatctctgactgaaaatattgagggtgggaaacctttgcatctgcaagctgcctgacaatcagaactgcagacagggaagttggcgttttgagaatgctcttgagattgaggtccatttctaattatctcttgtatctttagttcctggcacattgcttagcacataacaggcattcgtaaagactgctgaatgcctgaagaagtgagtgaataaatcctcctctagccacaggctatttaggagactcacactagtattaggagtagctggtataaatccaggtcagggcaggcactgtcccttacattccactgacctgagctgcagtgagatgatacttgtattaggctcttgtgagattcaagaaacaggagcatgctaaggttaaccccttaaagaacataaaatacatggaagtcagggagactggaaaccagctcagtatgtatagagaaggtctcccgcaagaccacgcagatcaagagagcaggagagattgttccctgacctgctgctccaccattgtgatgacagtgattttggcctgcctctgctattcccgttgactgctgcttgctcttctccaacctcacacctctgcctggtgtctggccttggagtttctcccagtttctgtggattctcctttctggtggctgtcactataggtcccaccgtccagctcttctgactgggttgtccagctatgtccaaaagaggtcctgctgtagaatgcagagcccttgtaccaggctgcatcagggacactgttctggatgtggcaagcccctcagacagggactattggggcaggcatttgaggcttcccagaagtacttgggctgtgcgctttgtgaagattgctgctgtatcttgagtgtcaaaccagaatgctttttcagtttacagtcatacctcattcacttagggctggctgtctcaggaatacttttatgatacacacaaatgcaaatccatgatggtgccaaaccttatgtagtcagtaaaaagacaaaagaaccccaggttgacaatagagggagcactttcgaagctctcaggcaggggcacctgcaggtcatagagacctagctctccttgatttagggtcacttttcctcagctgtgatctgtccttatgttcttcacccacaatgcctgacaaaagacgctggaggtacctcaaaagtgccagaggtggttttacgaagtttcagtctctttcaagaaaatgattgaggaaacagaatgaggctattagggattggcagaaattctttgacaatataaaagaaggacatcataagactcgtcgcagcctgggaggactgcctgatgatcatacagtattggaaagaatgatgttagaggttgtcaaacttcaggggatttgaggaggacagtcactgtctctttaatgattatgctgtaatgactgtgtgcattgcttatctcattttggggaaagcattctccccaccctcaagctatttcccaagaaatgaacacaggaaatttccaagaaatttcccaagcattctcctggacagttaccaggagaagagccctcatctttcctctgtcttcacaaaactggggctcactgacattttctttgccaatgtaaagggctgaatctgttctcttgttccacggtgagtgtcgccataagtccagatactgtttcccttctggggacttggcagctagcctgaacctcctgcctgggattagcagggaccgggggatggaggggaggctgcccaggtcattgtccttgttccccttgatctctccctttaagcagcagactcagtcactggcgccatcaatctagcacatttcataaacagtaaattcattttaaaaacctgctgctgagcagccatctgtctccatttttgtcaatctgctgttacagcaatgctagtgtactgtgaggttgtctttcattaaagactccttgatctgaaggtgagcacgttaaacatggagaggagctctgggccagctgacagcatttctgaccactagcctttcatcaccggaacctggagtttaaaacttatttttgacctaaaatgatgatattgatggtttctgtatcttgctgtgcttgatttacatactttaagattacagagtgttctaacatcctaacttactactgataaggtaggaagaagactgacaagtcttattaccatttaagtattactgtagataaacaggcacagagtagttaagtgcccaaggtcacgtagcaaggatgagaactgggaatatactggagctatggtctccctcctgaataactgagtcatctctatctgttttttttttttttttcatgtgaccatttcacaaaatctctacacatggacattttgctctccagagaccagtctgagcatagcaaagaggattggaaccagctctgagctgagttgtaggaagaagctgacacctggatcccaagccagtttttaatacataacatcctacaatgtattctctttgcagcacacaggacctctctccactaatcatttttattaggaggaaaacatattaaaaccaaaaaacctcaacaacataaaatcactgaaagcaagccaaggatgcagacagcaccagacgggattgtaggcagtggaaacactctcctgcaaaggaagcgtgttaacttacgctcaggccccataggcttgtcactagatgaaataatctgaaggaactcagagggtattttcctgtgcttaccacccctaagcacccttacaagccattttggataatagaagaagaatctaggtgggaagctggttcagagcccatcagaattccattatgcccatgatgttggcatgccctgttaacatgttaacatttagacctacctaaaataagtcagatctaatctccaagcatagatttcaaggcagtaagccatgctgctgttcattcctgcggcatcctgggttgtcactccctgcattgctccccaccaccttcctttgaggaaagtgcttggctttgacgtgttccctctagtgtctgtgctaatcctctttgtggctcttctactgctttgttcttatttttgacacgttgagcaaagcacctggaattggaagagtcagcttctctttgagcaatcagtggatgccaagaataatacttctgccttattcttgttccttggggtgatggtgaattctgtgtgtcaacttggctaggctgtggtgcccccttgtttgttcaaacacttgtctagatgttgctgtgaaggtaatttttagatgtgattaacatttcaatcagttgactttgaataaagtagattaccctccataatatggatgggcctcatccaacctgttgacggtcttaagaacaaagaccagtttcctaaagaagcagcagtgtttgcttcaagatggcaacatagaaattctgccagagtttccgtcctgctggcctgccctgaagattttggactcaaggctgtagcattgactcttatctgtatttacagtctgcctacctgccctacagattttggacttcccagacttcatatttgcatgaaacatatcttaaaataaatgtctgtctacctatccatccatctacccactcaaactatttgttctgcttctctggagagaggcacgaatacactaagcaactaatacacttagttaatttcaacatttccttctctacaaaggactagaagctaattagaacattctggagctgccccagccctgcctcttattagccctgcctcttgtgtgatcttggggaagttgcaaacatcactgcctctgtttactcaactgttaaataggagtagggtatttgctgctaggttgttatgaggattaaatgaggatgtgccacagagtaaatgttacgtttttaaaattaaagcaagtatattagaacatatccagcactttgggaggctgagatgggtggatcacctgaggtcaggagttcgagacctgccggggcaaaatggtgaaaccctgtctctactaaaaatacaaaaattagccaggcatggtggcatgcatctataatcccagctacttgggaggctgaggcaggagaatcacttgaaccttggaagtggaggttgcagtgagccaagatcatgccactgcactccagcctgggcaacagaacgagactccatctccaaaaaaataagaaattatttgatacaatatcaaatctattgatttgatgttgtaggcgtataaagatgttcatgtgtgttctagcatgtgaggaaggcgggaggaaatgtggaatgcccttcacgttgttcctgaatcattgcttctcgttttctggaggagtgtggtggtgtgttcgtaaaggaaaatgtaggggcattggaggtggatcaatccacccttaaatctttgttctcccatcttaccactttatgatttaaagcaaaggttactacctttttgagactcaggactttttaagacccttagtttgaccctagctctgtagaggtggaggtcttgagaatgtgcttagatgggtccgcagagaattcaccctgaaaaggaaggaactggaggacacaagcttggcacatgaccttgattagtcaccactaggacgcaagacttcaatgtgcctactccccaattttgccactaaattcatcccaaatcagtcaagagtgatggctataaaagcttggagaacattctccccagtggaagcctaatgaagagctataaaacctggtgaatagagcagcaaaaggtgttggcagtcgaggacaagtagaaaagagaaaagaactgctgttaaatgatgagggtttttagtgtgaacagctgttgagatgtctcagttggacacaagggcgggggcttggagggaagcttggcaccccacggtcattacctggtggtggtggtggggggatcaatttttaccaaaaataaaaatatatatttttaaaattttttttcttttctcgtactctggagcagctgttcttagccagtggagattttgccccccaggggacttttggaaatgtctggagtctttgattgtcatgaaggggaccagggttgctgtagtcatctagtgggcatctagagctgctaaacatcccacaatgcacagagcagccccacgagaaaatactcggctcaaaatgttagtagtgccgaggttgagaaatcctgctgtggcggccctccgtgccttaaatgaagagtaagcagccccggtacggactgttacactggtggcaataacagcgtaggagtcgcatggcttctcgcaggagagcaggaggctcaaatgtattttggatgtttcctctaagacgatgaattggcttgaatgtcttgtgtggtgctgtctcacccaaaccaggtgtatttcagaattgatttgaaaatgacttggagaccagttcacctattgcctcagcatgatggtaacatatagccaggacagagtccatgacagtaaaatggctttgatgaagtgactttgttcctgctcttcagctggggcttttggctcctcatttgatctccccagttagagtgcagactcagagtggccaagggctgcagatcctccctttcctgggcctccctccattcctcacaaagggcaggacctcaagaaagaaatgtttcatagaggaaagtcaccccctactttaatatacttcaacaggctgacaacctgaaaaaaaaattaggacaggaaggagaaaaccatctcagtgatgaatgttctaaaattagagtctacaatgcaggtattgtatttcttcagaatattaatataccctcactggaatatatcattgagatttcactggaaaattagaaagggcaagggaagagtttcagcctgaaggctattttgaatatcttaagtgattgaaataaacaaattaaaaaatgaatttgttatgttcggtactagatttatgacagggcagtacgtttgaggtcatttttactgtggcacatgaggaagcctcagaagatttctatgtcccaaagactgttcacaaaaatcttttccagattcttctagctgtatgggagcatagagaatggtgtttcctatcgaaagtgtttaagaggctgtcacttgctcaagatcatttagtcagtggctaagccagaactaaagccagcttcctggctgtgagaccatcaccctgtgctgctctgcatgccatttgtcatggtgtctgacattccacccttgacaggtagggagataaagagatgataggtatttggaatcaggcagatgtgaggatacagcacagttttgctcctccttttctgtggggcttacttaacttttctgattcttggttttctcatatgaaagtagagaaaataattattattagtggtttacttagctgtgtcatgaaaacgtctaggcctcgaaaagctccttactataatgcaattattacagtgactttttataacatagacgggtgttactcagattgtgattcacgaaacagttctcaagatgtgtttaagattttcaataattaatgtgtttcatggctaaataattgtaggagacaccagttaggtcaaggtaaacagaataggaattcttagagccttcaataggctaatgggtatgacttaataagagaatgtaataagaagcatttcacaaatatgtatgaccatagaactttttttaagtggaacatctgataatatcttgtgggatgctagtttccatgggacacagtttgggaattatggtaggttgattatattgatgtgtccactccttttttctgggctcagatacgtgacttattttggctgatcagcagttaactggcatgatgcaagcagagactgagaaagtccttgtgcattgaggcttgctgtcttgctgctctttataactacaaatcttaatcttccctggctccttcatcataactgttgtatcgaacccctgtagactccactggggatggtaccaggttcaagaggctgaagaagagacccagagccagggaatgagacatgagattttgctgggggcttacatacgggggagagagtccagtgttgacgggctggacagaattattgcatggcctagtggtggtgggctgggcaggagaatcacaactgcttgcaaaaaaacgtgtggcttttatagcattttcacttaacaccctttacctgacagcctccacttggcaactttcatgcaaccccaatctccatgtttcactggacagatagggagctcagatgttcctcatagacaaggaatgaatctccagattggccactcccaaatcccctagctcagaacacacattcaggtgcacctgccatatagggtcattctcagggtgtgcttaagttaatgctgtcggttggcatttaccatgtgctaaccatgagtatatgctagggttagcctcctggaagaatgagaaagatgtggggggagagtgggattgacaaagctgaggtcatttgaccttattgccccaagataaccactagccaaccaccatcagaaatgtgagtctcagctgagagccaactgacctagaaaacatataagtgagcccaactaggatcaggagaattttccaacttaaattacaaacttgtaggcctgtgagccaatcaatgatggttgttttaggccactcatttttgtgtggtcagttatgcagcattatgtgtagcaatgtaaagctgatacaggaattagaatggaaactgataggaaagtggaatgttcacactctggccccaactctttcttttattcccataggtaaaatacactctctccctcctcccaagatccttaaaggtctcatctaatcattccatcaggctcaaggtccaggatctcaaggtgttaaacaggtcctaatgcagttccttgggtacagttgctttgagttgaagatctatgagtgaaaaagataagaaatctgaccttcaaacctaatgcaatagggtaagaaaggacagaataagtatagtagacaatcttattcaaaaagggaaagaatggaaagctagtaagaggcactggctcatagcaatcctgaattccatccctgaaaatgctgccaggaccttctcttccagaggagggaatattcttgattaggcctcggttctgcctcgtggaagtgacttcccagtccattgttttctaaggctgtgttctgtaccatctgggttgtcttttctacccccttggctactcctgtgtgctttaaacaactttcttagcctgtttccagattgtggaaattagagacctagaggttttcttacattttgaatagtctcaatatcttttagtataaactggtgatccttttgtcaatatagtaccatcaaaacttttgtgagtttcttataaatctaatgggccaaaagcaacacctacaatagttttagagctagatctctctctagattcaaccatggttatttgggcaagttaagtactgtgagacagtgctcttaaaactcctagtagcacatttgttgagcttagaggatctgctgttttctgtcctgtttctttccagggtcttaatagacggtcttaaagcaagtatttgattagatccttgtctcaggctatattttactttaagactcttttgccagctgaagagacagatgaaaagcaattttcttttccaaccaagaagtcctagttcccctatggtctctctcaatttgcttaggcactggacagttatttttctagccctttcatttcttatagaatcttaccagtatgcagcagacactttcaacattatgcctggaaatgttattgctcaaatctcaagtttattaggcacattttctaccatctgaattgacacatgtagcagttttctcatttttttgttactgcataacccatgctgtcatctttccattctcttgtagcagtttcctcataatttttctagcctctgcccattttttttttgttatagcagccccctaattctagataacagtttcaatgttagttacttgttgccacaaataatgttgcatgacaagtcaccccaaaattcagtggcttaaacaatcatttatttagctcacaagtctgcagatcaactattgaggctgcattgttcttgtctctgacatattttcttgaggaatcaactgaccatcagcagatccagatggccttggctggggccacttggctaagctgcacatatgtgtcatggctagcccagtgagctagcccaatgcattctcattagcagtgtctgagtacaagagtatgcaaacctaaccatgcaagagggcaagcacaaatgcacagaggcttctccagcttctgcagccgtctcattggccaaagcagcataaatgatcaagtccagagctggaacaggacaagattacagtgttacagagcaagaggtatggatatagatagaccattaaatagtgccgttaataacctctgtatgccatagaaattatttctgtgtaaatataagaatttctgccaggtgtggcggctaacacctgtaatcccagcactttgggaggcggagcaggcaaatcacttgagttcaggagttagagaccagcctgcccaacgtggtgaaaccccatctctactaaaaatacaaaaattagctgggcgtggtggcaggtacctgtaatcccagctactggggaggctgaggcaggggaatctcttgaacctgagaggtggaggttgcagtgaacagagattgcaccactgcactccagcctgggcaacagagtgagaccctgtctcaaaaaaaaaaaaaaattcctgagttagaaccttgtgccagtgcctctctggaacagagttcactgatgtccttgtgggttaacggtgtcagtttattttccttttccggctctttcataaatttgtttgaagtattttcaatcctcctacatttcctgccagtatcatcttttcaaagtaaattccatatgtttattacctacagggttgagtgtcaccttctgttatttgtcctaagttagtcatcctactggggaaagtgaatagctgaaagaaatagagggaggagagggaagaacctgaggggtcaaaaatgattgccaaacccagaggtatctggaggtcagtgaagttgtgaatgtgtgtaaatgtggctacatatgtatatgtttgtaccagatgtgatgtttacatgagtgtgtatacaagaatttttattagtgtgggtatgtgtggatgtgtatacatctgtgtattagtgaatgtatatgtgtgtggtaatgagtattccttcccagttcattgaaaatcactatacgtgacctgattaatcaatgagccagttacataagtactcacagagcaaagccctatgggaaaagaaggaaatatgaaatacggagtcaaaaaggttgtaagaacaaagcaggagttgggggctcttacaccccagctttaacttccaagtttgagaaattctaaatggcattaaggaccatttaactccttctctccccacttccttcctccggtctgaacatggggagatatgggataaaaacaaccacgttgccttcccataaagtaatatgaaacaaaggagcacaagatggattttatccctttgattctcccaccaaagtgtcccatctttactggagatagaggacccgggagaagatatctagtcccttctctgtctcaagagtgggatgatgttctatttcctccgaaatactttatatttgagaaaacataccaggtatgtctttgccaagactctcttccaagaggcctggtttgagttaggagcttgcctgttattcactggtttcgtgagttctcagaatctctcagtgaagcgtcaggaatctggggttctttggaagtcctaattctagttccacacagtgcacaaagctcttaagacaggtgggagattttctgttatgttgtatgaaagcatttgttgttctagagaggaatcagaaagttgattccacttgatgtattagtggtgatctctgaggggaaacacctttcaattgggaggggacggtgaagtcatgagattgaaaacttttgcttgaagaattctgtaatcctagatgacctagtactacttagtcaatggataaaattacagaattactctataagggttagtattatcccatttcaggattaaacctcaaagagattaaatcatgtgcccatgatcactgaattgggatgattccagaagaatgctcttgggcacctcactctactgcctctatggccggtgatctatcccctccagagcaaatggctatgcacttcatttaccagtcccccatggtagagcagcaatacaaaaatgggttgactaggccggggcacggtggctcacgcctgtaatcccagcactttgggaggctgaggcgggtggatcacaaggtcaggagttcgagaccagcctagccgacatagtgaaaccctgtctctactaaaaatatgaaaattagccgggccttgtggtgggcgcctgtaatcctggctactagggaggctgaggcaggagaatcgcttacacctgggaggcagaggttgcagtgagctgaggttgcaccactgcactccagcctgggcaacagagtgagacttcatctcaaaaaaaaaaaaaaaaaaaggttgactataggttagcacagtctagatttcacactgtcccccgctgtccacagtctaattgcatacaaggctcagcctacaaaaccttgtcttagatacacattgaaccaaagttccctttatctcctcaaggaacagacagtgaggtgcaaaatcctaccctgttgttgctcagccttagacagtgagaattaatctaagaattaatagtacttcatattttaaacttgatttactatgattgcaagtcttaaaaatgatgcatgatatgttgattttgatataataatgtctgtttaataaaagacccacagtaggttttcatacattgtctccacctgaagataatgtttgacttcccagaccatacttgctattctatctcaagaaatactagagaaacaaatcctcacttatgcataaacatattcaaaggcaaaagatttctttattgatgagagcctcaaattgacccatttttagccttttctctgaaaagaaaaatgttttccaaaatgagattgctaccagatgtagtgaattacatagcagtttctcagatatgaaaagcagatgaaatggaatattctggtttctgattcagtcctattcttatctacacatagctcttcttaagtgaacttgacagtgttgtgggctgatattaagatggactactttagtaaacaagaaaaagggtttcactctgtgcaatagcaaatgagctttataatagaaatttctttgtgcaggagaagatattacaactttcaacacacactaaatatatttgctaggcaaaaaatgcatttcattacatgcagtgcacttgctattgtacgttaaccacttttttgccttgtattgaagacgtaatattttctactgtaaaatgtctgcaatttatttttatgcttctgtttttcccatgaagtaaatagccctgtactgataaatgtacgttatataaaaggtgaaatgtgcagagcaaacatctcagcttgtttgggtatctgtacggtttcgtgagcaggcaagagttaaaattttggaccacagtagctaattttattaatacaaacagtctgtaattactagatttactggagtcttttactttgacagtctcggcaactataatagatgtgtatgttctctaaaataatactattgcagctacaactataatttttcctgacaatgtctctgctggcttaaaaaaaccataattaatactttatttaatctttgcatactgtatacctagttgaccatcattcaaaatggcagtagcccagagcatagtttcttcacagctgaatgtatttgaccctaattactgcttattggaaatataccaaacaagtaaaaagggagctgtaacaaagaattgaggctttaattttgtctgtgatgagagaactttgatggtcactacttatttgtctgtaagagttgcggaagtctttgcaggttagagaattacaattatcttgctaatttcagtcttacacttgaacatgtttaatggactattgatggggattatgcttgttttatatttattttatcttgtatttagaagcgtatgattgactgtcagtggtcaggataggcataggctgatagggaaagggtttgttcccttttctgggaatgatgtagtttaagtactatttttgtagaaacaaatgccttcagtctgcctggctctatgttagggggtgctttatgcatgctgtcttatttagtcatcaccctatgacataggcattaacgttcccatattatagatctgggactagcacctcggtgtggttaagggatgtgccatggccacaaggtcagtgactgttgggccgggcttgactccagtgcagcctgagtgctcgcctacacagtaggagacatttccaaacatttgaagcctgggaatgaaagaaagtctgcttgcaaatagaggaggaaattgggaggtgatggaactagagggacggtgttttagtgatctaatatgtaaacacattcactatagcttgtttaaaatgctcattttcggtgcgctacacaggacagtttcttcagctacttatgacgggcttatttaatatgcgtgtgaaccttttaccatttcaatgaaaaataagtcaagctataagattcttagagatgtgatatctctattttctcagtttatgagaagaaactgagtattatgggaaaagaggtcttatgttttggagataaaccacctattattaagtccaataaataaacacagtagccatttcctgaaaagggctacaaccccccccaacacacaaaaccccaagaaccaacctcaaagtaaaatatccccgacccttaccaagaaaaaacaacttgttgtgaatcataatttgttgcatggacatttgtttagtctcattttctatacaattactaccaacatcttctatttttttcatttcatttttaccctcaatgaaaatgaactgtttattgagttaaaaataagcttccctacactttcaaatgttgtttttgatgtggtatttaaatattttccaacactgatcaatgactttttcttactgtaataggttaaaaatacctaagccagcaagaagagttcttatacaatggaatattcttctttttttttttaaccttttttttttttttttgaggcagggtgtcactctgtcacccaggttggggtgcagtggcgtaatctcggctcactgcaacctccacctcctgggttcaagcgattttcctgcctcaccctcccgagtagctgggattacagaaatgtgccaccacacctggctaatttttgcattttagtagactattaagtatttagtagagatggggtttcgtcatgttggccaggctggtctcgaactcctgacctcaagtgatccgcccaccttagcctcccaaaattctggattacagatgtgagccaccgtgcctggcctattattcagccttaaaaagaaatgaaattctgatacatgctacagtatggatgaaccttaaaggtgttatgctgagtgaaagaaaccagacacagaagggcaaatgctgttaagattcctcttacatgagatacctagaataggtgcattcatggagatgcagggaatagaagttaccagaggttagaagggtaagaggatgaggagttattgtatagtgagtacagaattttgttggggataatgtaaaagttttgggtataaatagtgatgattggttacataatattgtgaatgcatttaatgtcacagaattgtacacttatgactggctaaattgttaagtattttaccacaataaaaaagaaaaattaaaaaataagggttctgccaaggtattacaatgaagagacacaaagttctagcctctaatgctggacctaatacctgaatagattctgattcaacaacttcagaaagttcctgtgggcgttcttctttcattaacgttgataaatatttatttaaaagtaatgttatgtcatgtcagactctgagggactagagggatgagtaagggaggtctactgcctacaggagtggaaagacagccacattaaaaaatgattaaaatccagtaaatgggctgcaatagaaatgtaatgaatagtaggggaagcccaggagaagggctcctgagggaatcagggcctcgtagaacagttgataattgatctgggtttgaagtttgaataggaattgggttattttttattttcttatttcaataatatgcagtacattctcactcacatttcccaccttggaatcttggatctaagatatttgcagtcttttcaaatattttgtaatattttccccttgggtaagtataggcagattggtccctggaggtagaaaaacatcttgatcattctctgtcctactttctaaatatttgtaagcaaaaccactttgagaaataattcaaagtaaatgagatgtgttcagtccatcaaagagcttgtaatataatagggcaaggacagctgggtggcaagtgccttcagaaagtgtgggatggctgtgcagaggcaggaggagcgacttctgctggggcacgaaggcttatttcacatttaaggttgggtagaactgtgataactagatgtgaagaagattgtttcattcaaatagatgaacaaaagaagaaaagcaagaaaaaagatgaatccttttcagggaaacagtgaaaaagcaagttagagaggccctttggggccagatcacagggatctccaaaccttcaatattctgcttattctaaggagagaaaggcgtgaagagtcttcacccctctaccaatgtgaaaggatggtggagaataaaggagaataaaaagggatccaaaggcactggatggcattgggctcacaggtggatggaatgggtcgaactattaatagaagtatgaccagtgaaaaggagaatatgttttggagccagttagctttaggttcaaatcctgattcaaaagttactaactgcaaagttggacaaattacttaaaacttctgagcctcgttatccttgtgtgacaaatggggatgataatattatcttcatatagagttatcaggaggattaaagaggatggggtgacagatatacgtagtctccagaccactctcataggcacagatgttagttccttccccaggtgatctccaaagtcccatctaaacttgagagtctgtgaaataatttagaggatttaaaaaaatccaaagataaatgattcacataattgaagttaaaatatataaccaacatatttctagacaagtaacagaattcatttcaagtataaataaaaaatttacagccaaaacagatttttctagtgcagcagcttatctccagcaatgactctaatgtttttggaagctgaattaaccatttcactcccccaagttgccccgtagggctcatatccacgtgtttggaaatgatatcttcttgtcagatctaatatgaggtccctcagctttgtgtgagcacagagctcagagttgggggtttaccctgtgcaggatgtctttctgctaatgtgactgccagtaatacttgaaagtatcaatgcatgtttgaggatatccaccatgctttccattagaaatagcacaggctgtggtaccttcccctgtatccttactagacttcatgactttatagaactagccactttactgaattcttttttccttgttgtttttcacgtgaactgcttaggttttctattttacaatactagcatcatctgtaaatgatgtcttctcctttctgactgttgtgtctttatttgtgtctcttgatttggatataaatctgtcaggatgatggtggtagcaggcatggactgatggtaagggaaggtgtgtagggtttaatatgatatggacatatagtttgaatgccatagcacctgtcatatctttcttgttaccagaatcacatcatatagaaatttttgggaaaatgcctttttcttttttcttttctttctttcttttttttttttttttaagacggagtcttggctctgtcacccaggctggagtgcagtggcgcaatctcagttcactgcaacctccacctcctggattcaagtgattctcctgccctagtagctgggactacaggtgcctgccaccacgcccagctactttttttttttttttgtatttttaatagagatggggtttcaccatgctggccaggctggtctcgaactcctgacctcaagtgatctgcccgcctcgacctcccaaagtgctgggattacaggcatgagccaccgcgctgggccgaaaatgtctttttcacactgaactctgagcacattaaggagagggtcttttcttacttacctttatattcatagtgttagccctgagcctgaacaaaacacttgtgtagatatttatgggaggtatgagtaaatatcttaatttattagagatcagtaaaggtacttatcaataaaggtatcaataaaggacaaaaagtccaataagaaattatgaatatcttttcataatatcagagaacattaactgtttagctgtcttcctaaaaaatgtttcaattacaattaaggatgcttgtcttttttgtgattcttatgtaggatagcaggaaggggacaaaattttaagtcatatcccatttgttattaaaataaagaggggaagcccaaattctatctaaattgttggtccaagtgtggatcccttaatttcctttctaatgtgttttccagtaaacatacagatacataaatgcaagagttaataagattaatgggctactttgtatctgcccaggaggacacaaaacaaggtaaaatttattatttgtggatgctatgtcatactatttttaaaaatctactctaacactgtatattaatgctgtataatctcctttcttggtaatttccactccacaatttttatatattcctatttgaaataatgttttatctcttaatgtcactcatttattttatcatttttaaacaataggatatgagatgggactgaataatgagaaaaagatttcttaagggagaaataaaatatatcaaagaataatttgtaaaaccaatatggtagaagtcatatttattgaaaaaaattaatatctttgctataaaatttgtaacaggaatatttactgaatgtttattttgatgcataaacctgaatgttacataccaagtacaagacaataacactagtttttcctttatttacactttatgaaaactgttatgcagtccatgttaaaagaacttatgatggagaattgttacattagaaaaataatattcttgataaagcattctcaatgtgtccaatcatattttctgcctcttcaataaggcaaaagtccctggaacagcatataacttaatttacaaaatacaataactgtttagacacatattcaagttttcttttggtatgcttttccctcactgtaaaactttttcttttttctttttttctttttctttttctttttttttttttttttttttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatatt

SEQ ID NO: 796 - DNA, 100109 bp, Homo sapiens
caggtcaagtgaacagtaaagaacctgtctctgggtataaggttaaatattgcatattcattcctctaaaggactgaatatggtcttcaagagaatgattttcacttcttttggaatacctagaatttaacaatcaccaccacactgaaaaaatagtttttgtatagtaggcattagaactgaagagaactaaaccaagggagaaaagaatggtactttaaatagcactttcctccccaaataatgcctagctgcagtgatgttaaagtttaattcaaggacttcattactataagtacttaagagatttctatatttttatgtggtttttgaataatttctgtattgatttgtaagtaacttttttcaaagtaccaatttattttttaattttaatattttatttcttttgagacaggatcttgctctgtctcccaggctggtgtacagtggcgtgatcatagctcactgcagtctcaatttcccaggctgaagtgatcctcccacttcagcttcccaaggagctgggaccacaggagtgtgccatcatgcctggctaaatttttatttttatatttggtagagatgggggtcttgctatgttgccgaggctggtcttgaactcctgggctcaagggattctcccacctctgcttctcaaagtgctgggattacatgtgtaagccactgtgcccagtccaaagtaccaatttaattttacattttaaaaattggattctaaaagtctgccttcttatctgaacactatttttcagattccattttattttgttacttttttaaattgtgattggacaaaatgtttttcagtttctgtctttttttttttttttttttgagacagggtctcactgtcatccaggctggagtgcagtgatgcaatctcagctcactgcaccttccaccttccaggctcaagcagtcctccgacctcagcttcccaagtagctgggactacgggtcgcaccaccacacccagtgcagccctcaacagagaggagactggagtgggtagctcctatctgcaggcaggtcatcctgataagggtgtctggctaagtctgcaggtttttatgtgctcagaatggaggaagtgcatgttgattggttgatgggtggctggccatgggcaggcctggaaaaagcaccatccaattggccgattggtcatcaatgaacttcatactcctgttggtggacttcatccagaactggcagcctggcccctaggcttcaggccagtcctagcttgaaggaggggttctgccagggacccaccctttcctgcccaggaaactttcaacctcttgctgccaccaacatgacctccacagcaccctggctctagaggctgcggggagcccacaggcccatgccaagctactaccctcagccccttggctggacctccctcctgggcttgtgcccaaagtctagagggggctgaagtggcagggggctggcatgtcatcaccgctcttagtgcatgcacacccggctgggttgagacagtgcctcagcttagccacaactttgccccaccctggagtggatgccgtgagtcgggagaggccaggcagtgggagcaggcatttctaagcctgtaggggcaggggacttcctgggcccctgagagtgcggttgggcggctgcagctgctcctgggagcactggctcctaccctgccaagctgataggtggctggcctcctgcctgttcccagctcccggcagctctgctgaatgtccagcccccatggtgcctcccgctctgcagccaacatccttgtgggggccgctccagacgggccgtagcagccactgccttaaagtaaaatcggttgctgtaagggagtaaaagtagctttcattaaaggggatgatttcccaagcaagaagaaataagcaaaactacaaaatgttgcagataaggtgtacatcagatataagccgaaaaagagagtttgaggggttcttgctggagacttcaaagtcagtatgataaaagcttggagtacttgataggaaggaggccaactagagatgcagtgggatcatttttatgatcagggtgcagatttaagtgcaaggataaaaagggagacaccgaagatcaatgtagttattcttgaagaatgtaaggaagaattcatttttaaagtttattttaaagtagacaggtcagagggttttctgccttctgatgttaaaacatgttaaacccatctcaccaggtgagatcttcctttttctttttttaataacctttatttttacctcctgattttaaaaagacgattatgtaatgttatatagtaattgtaatagctaccatttgttgaatgtttatcccatgttaaatatactagtttatatatatgaatgccctaacttaaaaaaattcttatcaacccaaggaattaggtgcagtcatcatcctcattttacagatgaaggaacacatggaggtcatgtaacttgggcaggtcatggagctgacaagtaaggagccaaaactcaaaccatatttctttgattctaaagtctaatgatcccaagactacgttttaatgaaaatattcttttttatagcctgcttttattctgtacttaacatgtggttgctaaacattcctcaataatatatttaattgttgatccatattttacatgtgccttaatttatttaatgattcccccattgttgggtagtcagattgtttccatttttttgtattacaaataaaacacagtgatgaattttctcttaaatgtttttatggatttttctgattattttcttcggataaattttttgaatcttagttactaagcctaaagacattagtatatttaaggttgttgattcctgtgatgaaagtaacctcaagacacattgtcccaatttgcattcctagcatcagccatcagttcaggagattgttcattgaaccattcttttgacaatttgtaagactttgatttgttggccaaaatgtatacctctcatgattaacaggctgcgtactggaggtatgacagattgtcacatggccccatccagaggaaaagctgaaagagggactagtaatgccagtttcatacttatcaaacgattccatttttgtattaaacataggagtattaaaaatacgactggggaggccaggtgcggtggctcatgcctgtaatcccagcactttgggaggccaaggcgggcagatcacgaggtcaggagatcgagaccatcctggctaacacagtgaaactctgtctctactaaaaatacaaaaaattagccaggcttggtggctggctcctgtagtaccagctactcgggaagctgaggcaggagaatggcatgaacccgggaggcagagcttgcagtgagctgagattgcagcactgcactccagcatgggcgacaaagcgagactctgtctcaaaaaataggaaaaaaaaaaaaaaaaaaggaaaataccactgggggaagggagaccaaagaaaatttcatgaaataaagaattaaggacaccaaggactggtgctaggatctagcttgatgttagataataaaaatgacactgtattctctagaaaatttaaaaacctacctagtaataagttgtagaagactttatatgttttttgtgaatgggcagataggggtgttttgttgagtgtgagctcacactggaaaaaatcttgagtaatttttataatccattaaaggtaatgtgagagtgacttcagattgttgcttgaaggcataagctctggtctggaattaggatacctgggctctagtccagtgtagaattgttgctgcaatttgcaagtcatgtaacttctcgggccctcagtgtcttcctcataaaatgtgggttttggctaatgttctctgtcatttttttcaactctatgattccgtgacattgacttaatttattattacagtcagaaatgtcaacaaaacattcgtggaaactattgaaaatggaacagaaacatctttttgtataaaattatagtgtttctatagaagtctgtgtgtgcctttgcatgtacctttccatgcaatcaaacagaaatgaaaagtttccagaaaaggtcaacaagtaaatttactgaggggagaagtgtgtgattgagtgtctaggagtctcagggggtggagacaccaagggaaggctaatttgaagacataggcaaaatagttcagaacttaattcaggactttagaaattcattggccaaaaaattctaataaaatttcagtacaataataaaatgataaaagctgttggttgggtgaaaaaggccctttccttcaaatgttagaaaacaaaactaaggatactatttaaacttgaaagagataaatttggctgggcatggtggctcatgcctgtaatcccagcactttgggaggctgaggcagggggatcacctgaagtcaggagttcaaaatgaccagcctggccaatatggtggaacctcatctctactaaaaatacaaaagttagccaggcgtggtggcgtgtacctgtagtcccatttactcgggaagctgagacaggagaattggttgtacacgggaagtggaggttgcaatgagctgaggtcacaccactgcgctccatcctgggcaaaagagtgagactctgtctcaaaagagagagagagaaaaagaaatatatacatttaggactagtgaattaaatagcagggatgagcaagttaaagaatctcactcctagacccaaatgaaccttgagctgcctagaagactgaacctttgagagcagctgtatctgaagcttcaggccaaagaacagttctcagaagttgcattactagacttgacatgtgccagccatcaagacccacaaagcaaagatatagagcctgctgtagttctttcttcctaacaaattcgtttcaaatgctgaaggttttaaaatattttttctggcttaattttctaactagaatttggttttggctttgaaatttttgtctctttttgacttacctgtttatctgtgggggtaataatctgttacctggttatcatcttgaagtgaccccataatgttaagtagatggaagttgactttacattttacaagttgtctggtctaatctgtgtttaaaatattctgcaggcctagtctgtttttaacatattctatatgaaggggtggtttgcccctccacacctgtgggcgtttctcgttaggtggaacaagagacttggaaaagaaagagacacagagacaaagtatagagaaggaaaaaagggggcccaggggaccagcgttcagcatacggaggatctcgccggcctctgagttcccttagtatttattggtcattcttgggtgtttctcggagagggggatgtggcagggtcataggataatgagagaaagtcagcagataagcacgtgaacaaaggtctctgcatcatagacaaggtaaagaattaagtgctgtgctttagatatgcatacacataaacatctcaatgccttaaagagcagtattgctgcccgcctgtcccacctccagccctaaggcagttttccccatctcagtagatggaacatacaatctggttttatactgagacattccattgcccagagatgggcaggagacagatgccttcctcatgtctcaactgcaaagaggcgttccttcctcttttactaatcctcctcagcacagaccctttacaggtgtcgggctgggggacggtcaggtctttcccttcccacgaggccatatttcagactatcacatggggagaaaccttggacgatacctggctttcctaggcagaggtctctgcagggttttgtgtccctgggtacttgagattagggagtggtgatgactcttaaccactgctgccttcaagcatttgccttcaagcatttgtttaacaaagcacatcttgcacagcccttaatccatttaaccctgagttgacacagcacatgtttcagggagcacagggttgggggtaaggttacagattaacagcatctcaaggcagaagaatttctcttagtacagaacaaaatggagtctcttgtgtctacttctttctacacagacacagtaacaatctgatctctctttcttttccccacactatagatatttaacatgtcttgtagatgatccctgcctcccaacacacacattgactagattgcagtaacagtgaggtgagggcagaatctcagtcagaattcaacatctaacctttgttctctccctgtatcctcacatttccctccttggcctaaccttgaccctatgcttcagttttagttctacttttctaagaagcaatctatgattcagaagtagagtactcagccagctggccagctgtctgttttactgtctctccatgcatatacatacatccatgcagtcaattaactgctaacttttatttagcctatgctatataccgggaatacaaaggtgaatgaagcctacctcttgccttctagaggttcatagcatggtgagggagggaagttttgaagtgtggcctgggatcacaatggaggagtaagctgggaagtagtcaggtggtgatatttaaataggtaagaccataacactgacattgatttctttaatggttggatgtttacttaatcctgctgcctatctatagtgtagtaggccccctcttatctgtgggttctgtgttccaagaccaccagtggatgcctgaaaccatggaaagtactgaaccctacagatacagtattgttttcctatagtactggtcccttcatacacaatgttttttcctatatatacataattatgataaagtttaatttataaattaggtacagtaagacattaacaacaaacaatgcaatggaacaataataactatagttgtaataaaacttatgtgagtatggtctctctttctctggaaatatattattataaccatggaaagcaaaactgtaagagaggactactatagttttgtttcttcctccttcttagtagctgagaagcaatatagagcaggcactctcctgtgttagggacagggatcaatcataacatctttacatgaagggtggtgaaacagaagggcaggagtgcattaagagtcaactaggatggggggatatgactcaagtgctccagctcccaaactgaaagccagcagattcaaaagagggagagcttatcttgagaaaaaatgtcatggtgccacataaggtagggaccagctgtggtggtgtagctggcaagtctaaaatttgtagggcaggcccacagtctgagagctttcagataggatgagattcttgaggcagtatttcttcttcttcagagaaacttcaattttgttcttaaatccttgcaaatgattggtccatatagattggcccacatagattatcaaagataaactccataggtgttagccacatctccaaaatactttcatggcaaccccaaaatcagtgtttgactaactgggtaagcatagtgtagccaggttgacacataaaattaactgtcaccatgttcctgggttcaagaacttaaagccaaatatgcaacctggtttggcaagcctgtgatgagttcaggggctgcaagtgctctccaggctgtcaggaaggacatggttgatgacaggagcaagattttctgaccagtcacatttattcacattttggtttaaaaaagctgctttttaaatttgtttatttttatttttttgaaaggctctgtcactcaggccggagtccagtggtatgatcttggctcactgcaaacctccgtctcccgggttcaagcgagtctcccccctcagcctccccagtagctgggactacaggcgtgtgccaccactcccagctaatttttgtatttttagtagagacggggtttcaccatgttggccagactggtctcgaactcctgactctcagttgatctacccgccttggtctcccaaagtgctgggattacaggcatgagctgccatgcctgacctcaaaagcttcttatattatgagaaagtagagccatgactcacactgttattttgagtaaatgcaaaacagtacttaaaagatcattcttgttattatttatttacttattctagaccttttctgacagtgtgaaaaagattattcttaaaaaatcattatctatagtgaagatttaactttgaggagtttttaattatgctggagagtggagtaacattcatttggggtaagcctaagagttttgtttcctaacatgtttggcctctgattttgttgtttcgcccttttatttattcactagtcttgctgtagatactaatgcttgcctgtggtttaagagaaattaagcaacttaaaaacagagcaaatagaaatgtagttagctttgcctttcttttttgcttaatgtaagggtttcgtgggaattggtgttttgggagaagttcaaatgtatttgcttttggcaatggaacaataatggtaaaggtagggtgtcttaatgtagattggttcaatttagatatgaaagtctgaaatttatattggcttgaagattttagggcaggataattttataaattctcgttattgtcattttattgtgtctgacactttttcttgaatgtaaattctcctcccctccttattctaatctgcatgtataatacctcttttacccaaattatattgatttgccagcagtctttcttgtttcctctctttttttctcctttccacttgctgttgtttaaattcaaagagttttctttgtggagactgaacctaatagtaagacagcataaaacactgagttcagcagaaagtgatttgcttgtgattaacccttgagaattaactcactgcaagataacaaagaatgaatgttttccaaacatctggctcattcttcttttccattagtagatgagacctctccatttaccctctaggtgttaggaattctcatactgtttcacttaggctttatcatactcgtcacggcatattgttagaaagtaagtccaaaagagagttcatgacataccctttctctgccacagacctctcacagtccttgcagcaaaaggcagttagtgtcattcttttagttgttcaagacaataaccttgactcttctcttttccttttagttgctcaagacaactaaaaggtccttttagttccttttggttgcaaagactttattttctttgtcttccgagagacttttggatatatttacctggtccagggtattttgaagcatgaccatatgttagattcttaattacgtttaactagcattgtccattatattttctcatttcaaaaccttgactccatatccagtgtctcagcaaatcctattggccttacctccgaactctatctagtatctcaccactttcctcatttccatcattaatcgctgtagcccaagtgaccattatctctttcatggattattttaatagacttacaactcatccccatgcctctgcttttcatcctctacaatctattctcaacatgacaagtagaatgatccttagaattttaattgaaataatcttaggcctctgctcaaaacaatgatgtactgtatcactcggagaaaagctagtctttatgttgaccatataaggcccagcatgatctgctccccttgtgacctgttcgaccttgttgcctatttttttctctttctcttcctgctgtatgcacactggccttctggctattcgttaggcacactgggcacacctgtgctttagggactttacacttgttcccattgctagtccaaaatctaaggaatcctttttcttgctttaatttttttccaaaagtcatttttttcagtgaagcttgccctactcactttaaatttgttgctcttgtagcaggacaagccgcaggcaaaacctctcagacatcgagttgtagaaggaagggctttattcagctgggagcatcggcaagctactgtcttaaaatccaagctccccgagtgcacaatttccgtcccttttacgggcacacaacactaaagattttatatgaaagggttgtgattgattgagcaatctaggggatatgtgacggggtttcatgcactggtagtcagagtgaaacagaacagagcagggagtttcacaatgttcttccatacaatgcctgaaatctatgggtaacatcgggttctaagtcatgagttgatttttaactactaggtttaggccatgcaggctcgggcgtggttttgggcctggggccaggctgcctgtctttgatttcacttccttgtttttttcttaaaacaggtactgagtataaaatataaaacaatgtgagagggtctctctcttccctcactctcaccatacaaacacatacctacttctttatctgcttaatttttttccatagcacaaatcactgcgtaaaataattatatatttttcctgttaaaattgtttgttgtctgtctctcttgctaaaatgtaccttcatgaggatagggattttgtctgatatatccctagggcttaaaatcatgactggcacatagtaaatactgagtatttattgaattaattaatgaaccagtcagagatgggaaatagccttcaagtgcctgtttgctaaattacctaacctttttattgggagtttattttccttaatgtttgtttaacaaattagttattctttcatgttttccacataacctgtggattatcttcatttttttttttttgtaaggaaatttaccagacataaggtcctaactttattttctttgtcttccgtgagacttttgaatatatttacctggtccaggatattttgaagcatgaccatatgttagatttttaattaagtttaactagcattgtccattatattttcccatttcaaaacataatttcggtcaccagtatggtacacataaaatatgagctacaagagacatctcggtggtggtgagagacaggactagttggacttcctaggccgactaagaattcctaagcctaactggggaaggtgaccgcacctacctttaaacacagggcttgtaactcagctcacgcccaaccaatcaggtagtaaagagggctcactaaaatacaaattaagctaaaagcaggaggtaaagaaatagtcaaatcatatatcgcctgagagcacagggggaggggcagtgattgggatataaacccaggcattggagcagagagtgggcaaccccctttgggtcctctcacattgtacgggagctctgttttcattctattaaatcttgcaactgcacactcttctggtccgtgtttgttacggttcgagctgagcttttgctcgctgtccaccgctgctgtttgctgccgtcgcagacctgccgctgacttacacccctctggatccagcagggtgtccactgcgtttctgatccagtgaggtgcacattgccgcacctgatcaggctaaaggctcgcctttgttactgcacggctaagtgccctaatcgagctgaacactggttgctgggttccaccgttctcttccatgacccacagcttctaatagctataatactcaccacatggcccaaggttcaatttcttggaatctgtgaggccaagaaccccaggtcagagaacaaaaggcttgccgtcattttgggagcggcccaccccatgttgggagctctaagaccaaagacccgcccgtaacagtggtaaagtttcttaagatcattttcatgtcattatacaaacttttagaaaatgacgctttgctagattttggaaatccaaagaaataaaacacagtccctacctccggaagcctacatgttggaagggatttgaaataggtaaatgagtattaactaatgtaatatatattacagtagaaagatctcctgagtactatggagtactgaagagttttgtttgggtgagaggtgagtgaagaaagcttttttgagaagatgagcttgaagttgattgctgagtaagatttcccaggagtaaagcagagaggaacaaaaggagtaagagtaaataatatgagaatgaaaaaaggaccaacatggaatgtctgtgacgttcacataggtgctggttatttttcataaccttgtttgaatcattacgagcatgttaggatacaggtatttgtatcttaattttatagatgaggaaatgggcccaaagagaatagcttaggatcacagaatgttgaattggagcccaggcctgattaacttgaagcccatggactttccatagcagccccatacatagcattcaggtgtgaaggagtagaaagtataaggggctcatgcttgctgcatggatgaaaaacttgaaggcttatttagaaagtaaaagtttagtacgagccatgaggaatgggaaagggtactaattaatgatgaggaagatgatggtacagagtaggcttgaagggccagcgggcatcagaaaccataactgtgtaatgatgctatttagtgagaacataagatttttctttagctagacctagcagtctaggatgaggattctctgtggtaactctgccaccattttgaaaccattcgatttcactgacaatttgccatctgttgctttctgcagtgctattatgcatatgcctggaagtttttaaatccaaaatattcatgcattgtatatggtcagagagaatgcagtgaaagctatgctttttgtaatttttgacaagtgtactctaaagtaatgaattttaaaaacttaggccgggtgcattggcttacgcctattatcccagcactttgggaggccaaggcaggtggatcacctgaggtcaggagttcaagaccagcctgaccaaaatggagaaacctcgtctctactaaaaatacaaaaaaaaaaaaaaaaattacccgggtatggtggctcatgcctgtaatcccagctactggggaggctgaggcaggagaatcgtttgaacccgggaggcggaggttgtggtgagccgagattgcgccattgcgctctggcttgggcaacaagagcaaaactctgtctcaaaaataaacaaaaaacaaaaagcttaaatacccttgtcccatatcacataaatttgttttttgaatatatatcatctttttttcccccatggtgaccatgacagattattaaaaactaaatttctaaatttgatgtaagtagaatgttaggtttttggtttttcttacatagagaccactgttcccaaacattatgctggaccagttgtaaaagaatttttttggtggcatttgtaactgatttcatttttaagtatatatgtgcatatatttatagaaagatcagcttgttctataagtagaagtatgtggtaccctaattttgtgtaacaacaacaaaaatatatccaataattagattttctgcaggcctagaaaatgttagctacttttttaagccataaacgtctgaatcgtcagataaaatgtttcaaaactaaaacttgcccaaggcagccttgtgaatttttttttaaagaattaaaaaaaaagcctcatatggcatccatattcatcatctactgctacatatgtgtgacacttacggcagttttagcctatactagggtacaggaatatacttacttttttaaatcatacttcctgatttcttttattttcatatcccaatttttcctaagtcaaagaaacagcaacatttctgtttctgcagaatttaacctggttattgcctagttggtagaaaatgactgtagttgtggtaccaacactatgcctgattcaccattttactattatattgtcttttcaatgtcattttttctcattctgttactggcagtttagttttaaagcatcattgtttaaaaaacattcaaaataaaagtcgaaatacatcttcatgtttacaactggatcagatatggtgttgtgcatataaaagaaacaaaatacagatcctcttagcccaaggatatgatactgaagtttagtaaacgagaaatagcatagtgatgaaagcatgctaattgtttttcaacaatagtaaaatagagaacatgttaatggaattatctgatatttacacagttatgccaagtaaaccataggttattcagaaaccccagtgtgttttagatgttattttatttttaaaattaaagccaaagaaaggtatggtcaggagttctgtgttgagttacttacttagacttagattgactccctttctcttatacttctgttttctacatttgaaactagtttctttttcctgtttgagtcattcatatatgtggaagtttgaggagaattgttactgttttacagctcacaaaatctgtgtctgaaaagaaataccaatggctttttagcaaataaaaaaatgttaggtagtagataaatttttttctaggaaacaattcatattattctgggccagttaaagttttgtttgtttgtttgttttattttatttgtttgagacagagtcttgctctgtggcccaggctggagtgcaatggcatgataatcggcacactgcaacttccacttcccaggttcaagcagttctcctgcctcagccttttgagtagctggggctacaggcacctgccaacacacctggctaattttttgtatttttagtagagacggggttttgtcatgttggccaggctggtctcgaattcctgacctcaggtgatccacctgcctcagcctcccaaagtgctgggattacaggcatgagccactctgcccggccagttttaattgcttgtaaatctaacagccttactatttccacaggaaactttataagtacttttattctttcctttaaaattttaaaaaattttttagtttttttgagacagggtctcactctgtcaccaagctgaagtacagtggcataatcacagctcactgtggcctcaatctcctgggctcaagcaatccttccacttcaggctcccaagcagccaggactacaggcacacccaactaacttttctttagtagagacagggtcttcttgtgttgccgaggctggtctcactcctgggctaaatcagttctcccatctcagcctcccaaaatgaagacttttattcttacttcagattacaaaatatgattgtataggatacatgattaaaaaaaaatttcaagttgatttcaacttctaaatatgtttttgtttgtttactgtcaattgttcatgctcaaaaagttttattttaatatcaaattaaaatacaaagagaggtaatttagattaaaccctttcaatagagaatttttaagatttaaaaaatttttttagccttgatttgaaattgaataaggaattttaattccagtaaataaatgggtttttgattagctgtgctgtattttatcgttttagtgtggataagtaagatttgattgctcaattttggttatttactgaacatccttttttactctagtgatctacctaatttgggtttctttttgttgtttttgtttcttggtattttatttatttttttgagactaagtctcactgttgccgcccaggctggagtgcaatggcgcaatctcagctcactgcaacctccgcctcccaggttcaagggattctcctgtctcagcctcccgagtagctgggattacaggtgcctgccaccacacccagctaatttttttatttttagtataagcgatggggtttcaccatgttagcaaggctggtctcgaactcctgacctcagacgatccacccatctcagcctcccaaggtgctgggattacaggcgtgagccactgtgcccagctattttattttttatttcaataagttttgggggaacaggtggtgtttggttacatggataagttctttagtggtgacatctgagattttagtgtactcatcacctgaacactgtacccagtgtgtagtcttttatccctcgctcccacccattacctgccctgtgagtccccacaatccgttgtatcaattcttatgccttgcatcctcataccttagctcctagttataaatgagaacatacaatatttggttttccgttcctgagttacttcgcttagaataatggtctccaactccatccaggttgctgcaaatgccgttatttgttcatttttatggctgagtagtacttcatggtgtgtgtgtgtgtgtgtgtgtgtgtgtatatatatcacattttctttatccgctctttgatgagcatttgggctggttccatatttttgcaattgtgaattgtgctgccataaacatgcatgtgcagtatctttttcatatgattgcttattttcctctggttggatacccaagagtgggattgctggatcaaacagcagttctacttttagttctttaaggaatcttcatactgtttttcataggggttgtactagtttaccttcctaccagcagtgtaaaagtgttccctttcaccatatccatgccaacatctattattttttgattattattattatttttttgagatggagttttgctctgttgcccaggctggagtgcagtggcgtgatctcggctcactgcaacctctggctgcttggttcaagcgattctcctgcctcagcctgccgagtagctgggattacaggcatgctccaccacagccagctaatttttgtatttttagtagagacagggtttcaccatattggccaggatggtctcgatctcctgaccttgtgatacacctgtctcagcctcccaaagtgctgggattacaggtgtgagccaccacgcccagcctattttttgatttttaaattatggccattcttgctggagtaaggtggtatggcattatgggtttgatttgcatttccctgataattagtgatgttgagccatatgttttttggctatttgtgtatcttcttttgagaattgtctgttcatgtcttagcccacttttttttttgagacagagtctcactcttgtcactcaggctggagtgcagtggtgtgatctcagctcactacaacctccacctcctgggttcaagcgattctcctgcctcaacctcccaagtagctggattacaggtgcctgccactacacctggctaatttttgtattttagtagagacagggtttcaccatgttggccaggctggtctcgaactccctgacctcaggtgatccacctgccttggcctcccaaaagtgctggattacaggcatgagacactgtgctcggccattagcataatttttgatggcattatttgtttttttcttgctgattagtttgagtttcttgtagatagtgtgtattagtcctgtgttggatacatagtttgcaaagattttcccctactctgtgggttgtttattctgctgattatttcttttgctgtgcagaagctttttagtttaattagttcccatctatttatattagtttttgttgcatttgcttttggctttttgatcattcaggagcaggttatttaatgaaatctttgcctaaaccaatgtttggaagggtttttctgatgttatcttctataatttttatgcttttaggtcttagatttatccatcttgacttgatttttgtataaggtgagagatgaggatccagtttcattcttccacatgtggcttgccagttatctcagcaccatttgttgaatagggtgtcctttccccactttatgtttttatttgctttgtggaagatcagttgactgttaagtatttggctttatttctgggttctctattctgttctattggcctatatgcctgtttttgtaccagtaccatgctgttttggtgactatggctttatagtatagtttgaagtcaggtaatgtgatgcctccagatttgttctttttccttagttttgctttggctgcatgggctgtttttttggtgccgtatgaattttaggattgttttttctagctctgtaaatgatgatgctcgtattttgatgggaattgcattgagtttgtagattgcttttggcagtacagtcattttcacaatattgattctatccatccatgggcatgtgatgtgtttccatttgtgttgtgtgtgatttctttcagcagtcttttgtatgatagttttccttgtagaggttttttacctccatggttaggtatattcctttgtaattttttgtttgttttttctttgcagctattgtaaaaggggttgagttcttgatttgattctcaggttggtcactgttagtgtatagcagagctactgatttgtgtacattaattttgtatcctgaaactttgctgaattcattgatcaattctaggagatgtttgaaggagtcttcagggttttctggtatacaatcatatcttcagcaaatagtgacagtttgacctcctctttaccgatttggatgccctttatttccctctcttgtttgattgctctggctaggacttctagtactatgttgaatagaagtggtgtaagtgggcatccttgtcttgttgcagttcccagaaggaatgctttcaacttttctccactcagtattatgttggctgtgggtttgtcttttattaccctaaggtatgttccttctatcctgattttgctgagagttttaatcatgatggaatgctggattttgtcaaatgctttttctgtgcctgttgagatgatcgggtgattgttgtttccacttctgtttagtatatcacatttattcacttgtgtgtgttaaactatctctgcatccctggtatgaaaccctcttgatcatagtggattattgttttgatatgctgttgggtttgattagttagtattttgctgaggttttttgcatctatgttcatcagggattttggtctataggtgttcattttgttgttgttatgtcatttcctggttttggtattagggtgataactggcttcatagaatgatttagggaggattccctgtttatcttttggaatattttcaataggattggtactagttctgttttgaatgtctgacaaaattcagctgtaaatccatctggtcctggacttttttttgttgacagtttttttgattaccatttcagtctcacttattgttattggtatgttctgagtttctagttctaccttgtttaatcttggagggttgtatatttcctggaatttatccatctcctctaggttttctagtttctctgtgtaagggtgttcatagtactcttgaatgatctttttatttctgtggtattggttgtaatattgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtatttaccccagacaacgaggctgcttcagtatctcccgtttcatttctaatttagcgtatttggatcttctctcttcttttcttggttaatctaagggtctaccaattttacttatcttttcaaagaactgaaccagtttttgtttcacttttgttttgttgttgttgctgtttcaatttcctttagttcttctctgatccttctttctattctcttgctgggtttgggtttggtttgttcttgtttctctttttccttgaggtgtgaccttacattgtctatttgtgctccttcagaatttttgatgtattacatacattttgatttaatattatgaactttcctcttagcactgcttttgttttatcccagaggttttggtaggttgtgtcactaatgtcagttcagttcaaatacttttttatttttcatcttgatttcattgttgacccaaagatcattcaggagcaggttatttaatttctatgtatttgcatggttttgagggttccttttggagttgattttcagttttattccactgtggtccgagagagtacttgatataattttgattttcttaaatttattgagacttgttttttaattttttttttttttttagaaggagtttcgctcttgttgcctaggctgaagtgcaatagtgcaatctcagctcactgcaacctccacctcctgggttcaagcaagcctcccaagtagctgggactacaggcatgcaccaccacgcctggctaattttgtatttttagtagagacatggtttcaccatgttggtcaggctgattttgaactcctgacctcaggtgatccacctgcctcagcttcccaaagtgctggggttacagtgtgaaccactgtgcccagctgagactcattttgtggtctatcttggagaatgttctatgatgaatagaatgtatattcttgcagttgttgggtagaatgttctataaatatctgttaattccatttgttctagggtatagtttaagtccactgtttctttgttgactttctgtcttgataacctgtctagtgctgtcagtgaagtagtgaagtcccccactgttattgtgttgccatctatctcatttcttaggtctaatagtaaatttgggagctccagtgttaggtacatatatatctgggattgtggtattttcctgttggactgatctttttattatataatgtccctctttgtgttttttaactgttgttgctttgaagtctgttttgtctgttgtaagaacagccactcctgctggcttttggtgtccattgtcatggaataccttttgctacccctttatcttattatgtgaatgtgaaaattgttttgtttaaggaggctaaatataggacccagattccttcttgatcgtagggtttctgctgagaaatctactgttaatctctgataggttttcctttatagattacctgatatttttgcctcacaacacttaagattctttccttcatcttgactttagataacctgtgtttgtgcctacatgatttttttgcaatgaattttccaggtgttcttagagcttcttatatttggatgtctaggtctctagcaaggccagggaggttttcctcaactagtctctcaaatacattttctaaacttttagatttcccttctttgtcggggacaccagttattcttaggttatgtcatttaacgtaatcccaaacttcttggaggctttgttcctttttttaaattcttttttgtctttgtcagtttgggtcagtttgaaagccttgtctttgagctatgaagttcttttttctacttgttcgattctgttgtaactttccagtgtattttgcatttcctaagtgtgtctttcatttccagaagttgtgattgttttttctttatggtatctatttctctggatatttttatccatatactgtattatattttaaatttctttaagttggttttcacttttctttggtgcctccttgagtaacataataatcgaccttctgaaatctttatctgacaatttagagatttcttcttggtttggatccattgctggtgagctagtgtggtcttttggagatgttaaagaaccttgctttgtcatactaccagaattgtttttctggttctttctcgtttgggtagactacgtcagaggaaagatctggggctcaaaggctgctgttcagatccttttgtcccatggggtgatcctttgatgtggtgcactcccccttcctctagggattgggcttccggagagccagactgcagtgattgttactgctcttctgggtctagccacccagcagagctactgggctctgggctagtactggggagtgtctgcaaagagtcaaacacagatgtgatctgtgtttgagtctctcagctgtagataccagcacctgctccagtggaggtagcatgggagtgaagtggactctttgtagttttgtttagtgagttggttttcttgaatactgggtactagtagtacagttgttacatggacagactcaggacctctggttagccaggatgctacaggcagtggaaatagctgttttcttttttcttagagtgtggttgttcttttatgagttgctataatggcttgagtttgttggcttctagccaggaggtagagctttcaagagagcatcagctgcagcagtatgggggatacaagcttgccctaagatcacctggataagtatttggttttctcagctgatgggtggggacatagagctcccaagagattatgtcctttgtttttggctgtggggtgggttggtgtgggtggtggaaggcggcagtgtgtagagaaggatcaccaggttggggaagggtgaggcttgtctgactcagattgtccttgggcagggcttgctgtggccactgtggggtatgggggtgtggttctcagcactgggaatttgccccaggctataagcctcccactgagaaagcaagcatggctttcaggctccctgcatgctgcatcttctgtgttcatatctgcacttcctgtttgaacctctcccaccccttcctccattcctcccaggaaaattcatgctcaattgaaattatcacaaagttcatctggaactttccttctacctgtggtccttccctaattccagtggcaaccctcccgaaggacccctgtgagataaagtcagaaatggcttccctggggaccaggagtgcttatagggctcttcctgctgttgcttctacttttaattttcgctcagctctcttcagctctaggtaaggttaaatcctactgtttcctggattttcaggttccccagtgaggatgcatgttcagaggcagactccccctctcacactttgggcacttaacggtttttctgctgtctcatggagtctgcaatggcaagctgctgctttcaaagggtctgtgaattcttttggttttcctgatatgtttctggagtagttcttggagcaaaagttcacggtgtgagtctccacatgctgtttctgcacgtccgagtgggagctggaagttagtccagcttcctctccaccgtttttttctttttgttgtttttaaaggttacaaggcctttgtttttccttctgtaaaataagtctttagaagtagtctattaattttattattaaaaactcaagtttttattacattattattgaatgaaaaagtaaaatatatgtgacagaacttctgatgtgctctaggagttgaagattgaatgagatatccttcagtgagctcatatatttatatttcttcttctctttctttttttggagacggagttttgctcttgttgcccaggctggagtgcaacggcgcaatctcggctcaccgcttcccgggttcaagcgattctcctgtctcaacctcccgagtagctgggattacgggcgtgcgccaccatgcctggctaattttgtacttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgagcaacatggctgtttatttcacctgggtgcaggcgggctgagtccgaaaagagagtcagcaaagggtggtggattatcattagttcttacaggttttgggataggcggtgcagttaggagcaatgtttcgcgggcatggggtggatctcacaaagtgcattctgcagggtggggagaatcacaaagaaccttgttaagggtgggagagattacaaagtacactgatcagttagggtggggcagaaacaaatcacaatggaatgtcatcagttaaggctattttcacttcttttgaggatcttcagttgcttcgggctatctggatgtatacgtgcaggtcacaagggatatgatggcttagcttgggctcagggacctgacattcctgtcttcttatattaataagaaaagcaaaacaaaatagtgaagtgttggagcggcgaaaaattttgggggtggtatggagagataatgggcgatgtttctcagggctattcgagcgggattaggggcggcgtgggaacctacagttggagagattcaactggagaaagattttggggtaaggggtaatattgtggggttgttagaaggagcatttgtcatatagaattattggtgatggcctggatgtggttttgtatgaactgagaaagtaaacgaaagacacaaggtccgaataaaagaaggaggaaaataggtattaaaggactaagaattgggagtatccaggacatccaatcagagagtgtccaagggggttcaacgttattgtttgcttggttggcgagtttttgggctctatccttgagttttttatgttgtcatataccaggccagattgatttaggtaaaaacaacactcttcattaaaaaatatacagagtcctctttaacagtaagtcgaggccttggtgattttggaggaaagagaaatgcaaagccagcaactgtttgttgaagaaggattagaaacgtttgaggtaaaaccaggagccactaaataccaagagcctgagaaacagcttgggtgatttgactaataaaggccggtctgttattggactgtatagaggtgggaaggccaaactgaggaattatgtctgacagaagggaagaaatgactgcggtggtcttctcagatcctgtgggaaaggcctctacccacccagtgaaagtgtctacccagaccaagaggtattttagtttcctgacatgtgagtaaagtcaatttgccagtcctgggcaggggcaaatccctgagcttgttgtgtagggaagggatggggcctgagaaattcctgaggagtagcagaatagcagatggaatgctgagaagtgatttccttgaggatagatttccacgatggaaaggaaatgagaggttctaagaggcgggctagtggcttgtaacttaacatggaagaggttatgaaatgacgacagaatagaatgggcctgtgaggctggaaggggatattttccttggtccaagaactatttgccttgtgtgggaagagattgataggtggaagtttcagtgggggagtgggtgggagtggtcagatgagaaggagaaaagggatagaagtttgaacgctagctgcttttttagttaccttatcagcataagcattgtcctgagcgatgggatctgatgccttttgatggctgcttttttagctaccttgtcagcataagcgttgtcctgagcgatgggatctgatgccttttgatggtctttgcagtgaatgactccagcttcctttggaagtaaagcagctttgagaagagtttttattaaagaggcattgatgatggaggacccttgcatagtgaggaaacctctttctgcccatataacatcatggtggtacaggatatgtgaagtgggagcaggcatttcaaatggcggaaagcagtacaagagagggagagtgtggtgggaggtgccacatacttttcaatgaccaaatctcatttgtattcagagcgagaactcacttatcaccaagggaatggcccaagccgttcattagggatttgcccccatgatctacgcagctcctgccaagccccacctcattacatttccacatgagatgtgagtgtggacaaatgtttaaactataaggataaaaagcaagatctttaggagataagcatagagatttaggagattagcctacctgtcatgttcaagtttctatgtaggactcatatgatatagacccttgggccaactttaccctgttgcatgccccgtctctcacatgcaatacagtgactggtatgtagtgatgattttatcagtgaggatcctggtagtaataggtggattttttttttctttttgaagatagtttattgaagggactgttttcagaggtgtgaccatggtttaagataaccaagaaaggatgatgaatcacttagggactagcagcacttggaaactgttattcatccaggtgacagggcaagggtagaaatcatgttccagaactcagtgagagttgtaggcatgaaagaggagccttctcaacaggagctgtggccaaaaaagaaacaaggcaggtaagaaatggggaataaattatgccattatttctctttccttccactctttctttttctgctgatgcttcctctcactggtgaaacccaaccagaagctaaatggcaagtgaatccctagaaataaggcaaggcagagatgcagagcaaggcagataaaactagaaaatgggtctagggggagacaaatggaaataatcaacagagtgctcaatacttatttgttgaattaaactgaatttttattgttaaagtggaaaacaagcaaatgcctgatggtttaatgttttcttatatacaaaacttgaaataaaaatctctttgaaattttggaggcaactatttcatcttttgaatggttgaaatagtaaaaatgttgcaatacttaatctataaaaaattaaatactttatatttttcttttttcttttcttttttttgagacagagttttgctcttgttgcccaggctggagtgcaatggtgcagtcttggctcactgcaccctccgcctcctgggttcaagtgattctcctgcctcagccccctgagtagctgggattacaggagcccaccaccatgcccggctaattttcatatttttagtagatacggggtttcaccatgttggccaggctggtcgcaaactcctgacctcaggtaatccatctacctcggcttcccaaagtgctgggattacaggcatgagccaccacacccagcctttattttttgagagagtctctcatctgtcgcccaggctggagtgcagtggcacaatctcagctcactgcgacctccaccttccaggttcaagtgactctcatgcctcagcctcctgagtagctgggattacaggcacacgctcccatgcccagctaatttttgtatttttaatagagacggggtttcaccatgttggcaaggctggtcttgaaattctgacctcaggtgatctgcccgtcttggcctcccaaagtgttgggattacaggcgtgagccaccgcgtccagcttttattgatagtattaaaagcagttcacatttactgattgtttgacatgtcccaggtcactgtgctaaatcttttacgtgtattcttatattttatcctcacataaccctgtaacgtgtcaatactgttgctatactgttgggatgcatcactgtacaaaacaagttccacaaaggccacagatctttataatctgatattaatatttctataccattctgttgttattgttagtattctctggttactcttgaaattgagcgccttttcatatgttttagccatttaattttgtgtgtgtgttttgtgaaatcactgacttagtcttttgcccgttttctatttggttgtctttttattattaatttggaggaagcctgtgtatatttggatatgtgctattagctatgtgttgcaaatgacttctgccatctgggagattcaagctgaggtattaagagcaggtaggatttgggtaggcaaagatgagtgtttctagtgagatgaaagaataaacaaaattataagggaagaagatataattcacatattaaatagttgaatagtttgattggactaacaccagaaagctcaaaatatgtagcaccagggaagcgctagaaaatggcaaaaatatacctcagcagaacatttgctttaaatcaatacgtcttctattcaggaataacctatttcaggcaggctagacaacctgaaaggaaccccaaagatagtttgcctctctggtaggcagctctaggctttcgctcctctgccagggaatgaatcttcttttactgaaatggccttgctgtcattgccttgtgaaaaggtgtgacttaaaactggaactgatgaggggagaagcctagaggaaagtccttcctcttgtcctccggctctagatttctcagagtttttgcatattaaagttagaacaccttcatgcggctgcccttgctgacctgatgtttctcattatagagtcattccttgaaggttgggactttgatttcctatgacttggtgtatatttccctacagaacttgaatgccaatggctgaatggctttttggttttagcctccctttagtctcagcctccatcttactatgtctgcaccaatgaagaagtctattcattctgttccctagggagattatgctagtgttttaaaagtctctgccgactcttcaggatttgcctctcccaccatttatcagacaaaaatgtttctgtggtttcacttcttaattttgtatccattagaatttgttttggctccaagtgcctaaaacccaaaaatatagtggcttaggaagatggaacttttatttttatcccatgtattaataaataaaggcaattcagggatgggaaggcagctctgtgatcatctggaaccaatgtcttttcatctcattgttcttcctactttatccaagagggttgctccagcagcaatgtatgcattccagccagcaggaaggagaaatggagaaggacatctccttacccctctgtaggacttctcagaagttgcatacactactctggttgtatcttacgtgccaacgcttagttagcatagccatacctaaatctaagggaggcttggaaaaatatatctagctaaaaacaggaattcctgatcatattgaaaaaaaaaaaaaaagagaatggatattgaggattaccattgatccttgccacataaatcttttgttattgtgacactaatagtttcctgagatgtttaaggagaaaagctcagaatattgtgggtatatagccaatttaaaataaattatcatcagaattagcttatatctgacattctgaattttggacccttattttaaaatttttacactggtctagaaggtagaccttaacttttgaattttttatcatttttgataagtttggaagcttgacttctttcctaaacattgatgtaaggtttcatgaaatttttaagtatagcaaatgctgttgaacattgcaaatgtaaaatatggaggaggaaatatgtgctttttatctttatagaagataaatatattaaaccccctattaaaaatcgtctatagaaaaaattatagcaataggtagtataaaagctctgggttagagtggattcaaatatatggaaattaaatgaaaatctagaatcagttcactgagaattagctgatacagtgagcagcagatataatcccatagacactgcatatttttttaagtcctgatcttcacagtagagcttaaagaaagtgtagtattgtaatgtaattattctcattattaaaaatgatttacttttaaaacccagcatgttacatcataagtaatattcattttttcttccataggtaagaagtttgatagctgtaggactgggtgttgcagctcttgcatttgcaggtaagataaagaatacataccaataaattgcaggagaaatctttccaaatagcatctacagtgattcatgagtagacccttagtattctgaggttttggttttcagacataatacattctcattctttccaccatttgtagttactgaacatttgtcattgtagcaaaatctagataaactttatagggaagaaaattagtgataaaaagccagaaaaactagctccaataatagtttattcctggcattttttttcagtttgaagtatagtatactataaaaagaaattttaatattatgcaatgtaagtggcatggagtgcctttattctcccatatttattttttcttgcagacaggtttatacattttaagctgtcagttctttctcatgagcatagttgttccgtgtagtttattgatttgtctctaaacatattggtataattaccttgataaaccctggggaatttttttcactgctaaaattacgtttttcgaaagaatagttcttttttttttcttttttttggaatgggcaagactgtgccccttccagaggctctggggagaagccctttccttacccttcctggcctacagagtttgccttcatccttggctcatggacccttcctccattttcaaagccaacagcttagcatcttccaacctctgtctgactgtcactctcctccttctctcttaaaaagattttgtgattacactgggcccacctggataatcaaggatcatctccccatctcaagatcctgaacctaatcacatctgcaaagtcagttttattacataagggtaacatattctcaggttccaaggattaggacatggacatctttgaaggccattattcagcacagcacaatgctagtttttcttttttttgagacggagtcttgctctgcccaggctggagtgcagtggggcgatctctgctcacttcaagctccgcctcccgggttcatgccattctcctgcctcagcctcccgagtagctgggactacaggcgccagccaccatgcccagctaatgttttttgtatttttagtataaaaatacaaaatttagccaggatggtttcgatcgcctgacctcgtgatccacccacctcggcctcctaaagggctgggattacaggcgtgagccaccgtgcccggcccattcgaaagaatagttctgaagatctaaagtaaatttgctgagtctgtcattaacttacagcagttttaaattacatagctatatcctaattaaatgttaatttgagaatatgtccttattgataaagatttacttttttgttctagcatttgtgtttgtaagttctatcggtttgatcttgttaattggctcttttaggcagagctgcattccattttggctatatagagtttagtaagatctgatagaaaaatgagaaataagagggtcttgttttgtatggtatttattttctcacaattatcatttaaaacactattttaaccttttgtcttggaaatgatgaaacacttcaacaatcagaactttaaaatctagatcagtggttcagattctcttgatgtttttgtcatcaaggtcttatgtctcagttatataacttatacttaatgaatttctgaggttttatgagaagaatatcatgtctcaaacagaattctgacaaacttgcccctaaacataaaggaattttagtattaattagagtaggcatagttatgaattcaaatgtaaggttttgatttgaaattagataaagatgtattttttccagggtcgtctttgtaaaatgacaagaattggtgtgtgtattctttatagaccacaccattcccaaactcgtattactgactagaatattatattaaataacaacaagatctcttccagagccaaatacaaccaaataatagaatttaggagaaagtacacttagatgtgttagaactaggtcttctagttagagtaaacctccaggtgtcacttcttgaagcatttaactgctttttaactgagattagaagtcagtcactgtggttttgaagaattttgaggtaatataaaagctacatttcatactattataaaatcaaatggaagatgacatctatgtgataagagatacaggcaagttagggaatcagcctcatttaatttcactttatttaatgttctcctttatctcaagacctttttatcttcacattttcccatttctggcatcctgtctttcactgtaacatgtttgcacagaataacagtatacataggcaggtaaatttttctaaaacagtatacataggtagttgaatttttgcagtagaactcttgatttgcaaataggcttatggttagaagttgaattaaagcctgtagtgtcatatactggttttctagcaagactcttggagaaagagatactagtagaagacacaatctgattggggtgcaaaagataaagtagctagataatattttactcttatttgatgccctcaaaataatttagaacctgttttactattgactcttagttgttaaaactcaggggagttttgattattgggattcccaactagggaaagaactaaaaataagttttcagagagagtagccatcctcagtgagaaaaattgataattaacatccttggtaagtatttcatatgtaattgcttttttactttagagataattgattaaaaccatttctgtgtagtatagatcataaatataatttgttttctatatatttcaaagtgattatcataaaaagcaatacaattaaccattttagtattataagtatcttttatatgtaataggactttacagtttgttgtataaagaatactaggatgttattttttttgtgacctataccataatataaatgtaagatattacacataaacattgaaaatttctagttttatgatcataaactagaacttgataaatttaatggctatgataatggtattaacatgaaattttgccctccaataaattaaaaatttgaaaaaattgaccatctttctggtaagttttgaaatacttattgcaataacatatataaactatcaataaatactgttgcaagcactttgaaggtgttgattgattttgattatagaaaatacatttgcttttattccctttactatttaggtcgctacgcatttcggatctggaaacctctagaacaagttatcacagaaactgcaaagaagatttcaactcctgtaagttaaacgtggctttagttagaagactcattttgatttttgttcatatgacatatttcaattaacttagaaaatgtcttggattttccaatgtttgtagaagtttgtttccttcactatatcattggtgagtttgtctaatttactggctcagtttcttttaagttattggtcacattatttttatatctaactttattcctggttttgacatctaattattataatctgtttagtagtattacatcaaatttgatgtaacttactttacccgtttagttactgttcatttattcaataaacatttagtgagtcccccatccctgtgccaggagcttggaatagctgatgaacaaagaagacatggttcttgtcctgatgaagcttatccaagagttgatgccatcttgtaatttgaaactagtccccttataccatcatgcctggccatctcaaacataaaattatgagatttcaaccatgaaatcctgtagaacttattatacatttttgtaccagcattatagctactctggggagctgaatgtaagtgaaaaaatgaatgagagtatgtatccgtaaaagcaacagtatggattgtagtttgtaaccactgaagacaatataaagaaaagtcagtgaggccctgcagcgtaaacattggcttcagggaaacagaagcagatctgggatagatcaacttggttgagacttgagattgtcaaattgctgcaaaccaagttgatcatccgctattctgctattctgagttcctggcacagggatggggactcactaaatgtttattaaataaatgaacagtaattaaacagggaaagtaagttatgtcaaagttgatataatactactaaatgtaaaactactaaactacctactttatatatgttatttcaataaatatttcaaaacttaccagaaagactgtcattttttccaaatttataatttattggaggacagaatgtcatgttaataccattatcacagctattaaatttatcaagttctagttcatgatcataaaaccagaaattttcaatgtttatgtatagtatctttatattatggtataggtcacaaaaaatgaattgcttcttttagcaaagacattacaggcttgtgaggcttagttagccatgaataatgacagcaccaaaggatgacatactgacaaataattaaacttagattcaaaaaaacagcaagtgattttacagtcctataaatgcatgtctgtgattagagggaacataggtgtattttctgttttcctatttatattttatttggctaaaatattggtaggtattcagtaaatattctttgagcacctactacatactacattaccatagacagtgggatatagttatggaccaaagacattgccgtctaggagcttacatgttagtggagagacacagtgtaaaaaaaaaaaaatgaagtaagatatataatacctaaaagtgtcgagtgcttttgagaaaaccaaatcagggtaagaggttaaagagtaacagcaatgaggaatctttaccttagataggccaggtaaggtttctccaagaagataagggagcaggccatacaagcctctggtgtaagagcttcctaggtggtgggatcactgcaaaggtcctgaggtgcaaatgagtctagcagcaagagtaactccaaaggagtatatgaagggaatagtggtagcttgggcccagatcccttagggcctaatagacaatgaaaaaaaacttcaaattttaccttaagcgtgaaagaaagcccttggaagggtttgagcatggaggcaatgtgatttgtattttaagttatcactctgcttgctaccttagagccagagtagaagctgtgaaaccagtaagcgggtattgagatagtccgggtgatagatgatggtggcttgaaatagagtagtagcaatggacacagtaacatagttctttaaatgaattctatttatatatttccatatgtttataaataataaatggaaagaatttcagaaatcgtttcttttctgttacggtgatcttcaatatagtgtaaatagaaaattaccaagctgtgcaaaactacattatttaacattgtaaaggaagagagagcaagaaaatgagaaaatcttcagtagttggtagaggcttacagataaggccgggtaattcaagagattataagggatatactcatgtaaactctttattcagtggctcatatgacctgctccctcatctcagaggagccttacttaagagtctgagcctggtacctgcgtttcttaaagggaaatgatgtgtgtacccccttttccctctttgtggggctcaaggtaagaaacttcgccttcaataaatctggcttctttttcacaaagtgctactcttaagagtttgcagtaaaacatcttagaatatctttatcattgtcataatcataattatatttttacctcaggaaagatgcaagtacttttaaacaattttaaaactagtaatcatttccagggaaactgagaaatgaaatatgtgcatactttctgttggtactaatgaatcccagtgtcacacctcataaacacagtatacacagtgttttgattttgtaaatattattaattattgaaccaaatagggttactaaaaagacaggaactgtaattgtgggtcactaaatctctgtcattcaaaaaagattgtccaaggctcaagtttcaacggggggtctcttttccttgtttctttaaactttatttgctttctctaagctttaacatgttgtttttcaatcttatctctttttcatacttttttttcatcttgctgaaatagtgccttggataagtcttttatatggaatgcatggatggtaaatgtattttctgctttgttaaacagtttgtttcttttgttctcactgttaattatcagctgctagctccttgaaatctggtgaagccaacattagagaagtatagaaatctctgctgagactaagccttagtgcctgaactcccgcattcctgcatactcacagctagattttttggtggtcttattattcttattccattgtagacaacctattgttttggttttcttttgttgtttgggttttggggttttacattttggtggtggtggcttttatttttagctctgaaagtttgtaggattttctctttcttactgatgttctggaatttcacaagaattcttagtgagccctaacttatttgaaaatggtctttagttctgtaagattttcttacagttttttcttttattatttcttcctttcattgtctctcttttctgcttctggaactctgaacagagagatgagaaagatgttggacctgataaaaagatgtctgtcctctatgtctcttaccattttatctcttattttccatctccttatctttctttgctcttcattctacagtattttcacagcttattttccagatcaccaggttggcctttagcaatgtctattctgtttttcatctatccaccgaattcttcacatcagcattttttttttttttttggagacagagcctagtagtgcggttgcgcaatctcggctcactgcaacttctgcctcctgagtttaagtgattttcctacctcagcttcctaagtagttgggattgcaggcactcgtcactattcccagctaatttttgtatttttagtggagatggagtttcaccatgttggccaggctggtcttgagcttctgacctcaagtgatccacccacctcaacctcccaaattgctgggattataggcgtgagccactgcgcccggccaacgttagtaattttctaacttccaaggattctttcttgtttcttttttctggcaacccattttttaattaatgtggtatccttttgaatatttctaaagccattaattagcatttggccaaattctcttctgcttcctaatttatctccttttcctaaagtcagttgttatgtgttcatattggttctttttttcccctccatgataattgggtttgctcaaatgtccagtgatccttggttgttgattcatatttatgatgactaaattgactaatagaagtaatgttcttgacttttcttcagcagtttggtagggttgcttcaacagcttaattgaatgacagtgttgacagtgggctgtaaataacataggtgggtttgttaacaggcatgtctttcagagcaaggagactagaaggcagcattggtacctggagagtccaggagaggttgagcaccgtgtatattttactccttggcatagcttctcacctccctaggcttctgggttctgaaatgggatctgctggtatgcctctttggttctcttagtacctaccacccaaaataagatgcgtatcagaaaaagaggcatatggttctctttctcagcctgagggcatgacaggtacctggcctcttatgctctatatgagtagagtaggaatgatctgtttatattgttctggtttaataagtttcgctgatttttttattgttgttgactctgaatttagtgttcttgttttcctgaaaagggtttctttttttctctgatgtttgaagctgctgggatttttctgtacatgcaaattttacctaggatttctttaaactttctggtttgctatttatcccatttcttgttttctaggcctattaagggtgttttaaaatttacagtgtctttactcatttcaaaggcacttcggaaagcaaaagatctttatgattcagtctgctcttttgaacaagtgcccttttgcttgtttttttgttttttttttaaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaagtcctaatataatgcaatgtgggtatattattttcaagcttaaaaggacctttcagttttattagtggggaggagtacagagttacaattttgtgctttctcatgacatagatattaattcaaacataataatggattaaaatactgtgataacagttttgttctatttaaagttatataagacctaaattttctagaagtttaggaagcatgattttctctgaagaaatgtgtaaatacagttgacccttgaacaacctgggtttgaactgcacaggtccacttaatcatgattttaaaaaataaactcaatgagccctccatgtctgcaatgaaatgtagatcaaaaatgtagtattcatgggatgcaaaactcacctatgctgaggccaactttttgtatctgtggtttctgtagggctgaccgtggtgcctgagtgcagattttagtatgagtggtcctggaaccagtcacccacagatactgagggttgaatgtattttagtagtgtgtaacatagcaattttttgttttctctttgtatacttttctgcacccagccccacatgttaagtctctattctcaaaatggtctagatctttttggaagggttgtgttgattatatgtatatacagattgacttactcgtaataaaatcagtgttcatatgaacttcttcccgacactagatttttggcagccttttctgaaactctatgtctacctgggcaaaactgaaagtgaaaaaattgctcagataccaatacctgcttttaagattaatgagcttggtgactatagtgggaatgacagtttatgaaacatgataaatttatcttttttattatgctggctccaaattttagagctccctaaggtaaataaagactcattgaaatatttttttcctgaataaagaattattctatgtagtagttcaggcatgatttaaaaacaaaagtaggagcaaatatttggtgatacttctgttttgttatgactaaatcaactaattacctttaatttagggagtaacgtatgcatctagtaaaaattttggtttcctgaaagaaaccttaaaaccagcccctattcctctaagtccctcgttttttgagacagtctgtctccattgcccaggctggagtgcagctgtgcactcacagctcactgcaacctccacctcccagggtcaagtgattctcctgcctcagcctccagagtagctgggattacaggcatgcaccactacacccagctaagtttttgtatctttagtagagacggggtttcactgtgttggccaggctggtctctaactgacctgaggtgatccgcccgcctcagcctcgcaaagtgctgggattacaggcgtgaggcaccacagtcggcccccttacttctttccatttgtatctgtatctgtatttctctctctatctctctttatatatgtgcatactctctatgtatgtttagaaagatataaaatttgttcaggttagtatgtgtgcttaacccaatttgattatccttcctctcctcaaaacttgtgtcaggggtgggggactatttgtttttttactggattataaattacttgaaacttggagagtatattatattctcacagtattgattcattgatagattagcatctgtgtgatgaaggacagtccttgatctctcatttgaaaagtgcctggtacacagcaattgctgaagtgtttattgaatgaattaattgccaggaattatttattaccaagtagaaatttataataagctgttcaaagagtatagcttatataaatggccagatctgactccctagaacccattttttaagctctagtcatttccttagtttcttttagtattcttctttctttaattgtataaatagcctgtgctcattgttgaaaatttagaagttaaaaacaaagaaaaaattataatcccaccagctaaaaataactttaaagttatatgctttcagattttatttcatgtaagcatacctatttttccctacttttgtaaggaaatggtttcatgcttagaaacgtttaatgcctgtaatcatatatgtgtatgtttcctcctaaaagctaagtttatacatcctgtttctctgtttagagctactgaaaatagtgtctttacttgctgtctccattcctttctttccattctgtcttaaatacactctaatcatacgctcacctcactttctgcagctcttctcagtttttgatgtcctctttgctaaatccagaggtcagtttgtggctctcattttactttacctattagaaactttgaaaccatttttcatttcctcactcttgacttgtagttaccatcctcctttactgctaggccttgtcagcctccttgactgattcctctccatttctataccacaaagtgttgcagtctttagggaagactccttggacttctaatttttaaaccatcttacttcagtctcatggctttaaatgctatctgtacactaatgactctcaaatgtaaagtctgatgttaagtcagacattctccacttggatatttaagacattttaaacttagtatatccgaaatcattctcctcatgtctgttattcacaacaaataaacagctgctcctttcctcagtcattaaatggcaatttggcagtttaggccagaaaccttgaagtcatttgcacagcttgggttctctggaaagcagagtgagataaagattagcaagctatacttttattaaagagtgctcttagcataaacaactccagaaagaaagggaaggacaagttaggcttcagtgcattcctacaaaagcctcagccaatctcacaataacctctaagcaaggatggctcattgtagttatcccaagttggggcaaggggtcataggattaaatgacattacccaggaagtgagcatatatataagaagtccaaggactgaaccctagagaaatacaatgtttctatcccatgtcaaccagtcagtagatacaggctgccctgcaaagtgggataagcttgacttcctttaggcaaggcaattcctaaagtgtctgacagctgggagctatcagccagccacagccccagtgtctggggagtaagtccttcacgcctgatggggatctgatgagcacataacagtgtcctcaacatcattcttaatttttctttttctcatatcccaaattcaatccatcaaggaaatgttagttctgttttaaatatacatccagaatctaaccacttttatcacctcctctgctaccgccttagttcataccatcatcatctgttgtctggattattgttatgttttctgaactggtctgctacttctactcttgcacctttctattctctacatggcagttagattaaatcgaagttagattgttattccagtgctctggcttctcctcccacttaaaattctaaattccttccattgtttacaaggccatccacagtctggttcccattatatctcgagtcctccttttctccttgttcacgcctctccagcagcattgaaaccttttaatccagcttcccagcctctcttggcttgcctgtctgctagtgtgacatactcccctcttcattagttcctccccattctctgttggctagtgtggtaggctaaacgatgtctgccatatcaacattaaatgacttcatcaaggttatccaatgagaaaagtactacagagcttagaaaaagttcaagcattttgcttctaccagtctgttttgttctttctgttgtatcttggtgtagaaaaattaatctgttttaaagtgaaaaaaagttagtattttttaagacttcatattggtcaaaatttcttgaaaagtttcattgtttggtgcttccccccgccccataattttgagttgacttctagtaaaatgcattactctcactgcagctacatgatgagattgaggtcatgccacctcatacgtggaactaatgatttcttgctctttctttcctatacagagcttttcatcctactataaaggaggatttgaacagaaaatgagtaggcgagaagctggtcttattttaggtgtaaggtaggtgtgcagcataagtattgttttgttgtgtggccaagcttgtctttaaaaaagagaaaacgttacaataaggttatacttagacttaaaattatgagtaggtggcagaggagaaaatatcaaatttttatattttaaagcctcaaatctaaaagtatcccactcccctaaaaaaacaaaacaaaacaaaacaaaaaaacaggcaaagttgtgaagtacctttattctttaacaaggatctataatatttgaatactgatgtttcagttaaccaaaatatccttttttgtgacattctctctagactcagttttataatttgatatcatattgttaattataatccaggatatgtttcatagttcttttctgcttctgcagtgtgacatcaagcatatttattgtgcttgtttcaccttagtatccttttattgtctaactttggacaatatgagagaaaattaatgatattatataattgctgtgtgatatcatttaacatttaatgttaagaatattttcccctatgataatcatttgtttaccatatgttcccttagagcctactctcaagtttttgtgggaattggttacagtatgtcatgtacaacaaatcttctgatgatataatcaacacaattaagcaaattagataataaagtcctgtattgacaaaaatgttttgatatcttgtaaattttttaaaatttaaagattttttaaaaagccaaaacattttattatttcttatgacctagcagaaaaaacaagagttgggaggaggagcccagtttagtttggtgctttatttaagagatctcatctcttcttagatgagatctctccttaccagacaatagaaaataggaaatgattttaagcatgagggtcagattaggaagtttgctatactgccaactatttcttgcttaatatcattcagaatggcattgttatttttcctgaacttttattggcctcccaaaataccctgttgattatcttgaaatctgagtataaaacattataaaaccaagtacaaaggtttttgaggatatcctttaatattatgcagggcacttacgttgttaggacagacaggagttgactgtatttttacattctcttaagatatatatttataaagttttatcccatagaactgaaagctgtataaaattcacttggaaaattcagtgattaagagcacagactctggtatcaagtatatatgcgtacaaataccagtttaacacctattaaatgggtgaccccagtttaatcatctgtaaaatagagataatagattagttttaactgcataaagttgccgtgaagattaaattatataatatatgtgaatttctttttttggaagtttttttcttttttaaacttttaggttcagggttacacgtgcaggtttattataaagataaacttgtgtcacaggggtttgttgtatagattattttgtcacccaagtactaagcctagtacccaatagttattttttctgctcctctcttacctcctaccctccaccctcaggtaggcctcagtgtctgtttttcccctcttactatttagctcccacatgtaagtgagaacatgtgatatttggttttctgtttctgcattagtttgctgaggataatggcttccagttcatccatgtttctgcaaagcccacgatctcattactttttgtggctgcgtagtattccatggtgtttatgtaccacattttctttatcctgtctaccactgatgggcatttaggttgattccatatgtttgctgttgtaaatattgccacagtgaacatatgtctgcaacacatggtacttactaactactcaataaatagcagccaagcaaagcagattattgccctgagtctgtcgcttaggcgctgccctgtatgatcttggtcaagcttttttgttttgttttgtttttagcttttctatactttggcttcttcatttttgaattgagagtaataatattctgccttgttggaataatataagaatgatatgatgatacctttttacataatacctaccaaatatcaggtgctgaaaaaaatttggctcctgtttctttccatgtctgtcacgaacgcagaagctagatatttgtcctaacacattaagtggaaaggtaaatgaaacttatctgctttcctctagccctttcttttcagtcaggcaatgttgattatgacaagataattttaagatgtgagtatattcattgaatctcagctgtgtagactatataacaggtaggtgaaggcaaaatggagccgatccttttgataacctattttaaaaatactgtatgtgttctagatgatactatacattctgacatattgcatatgagaattgtttattgaaatgtgtatttgagtctttgccttatgtttttccttgcaagagaatagtgtcctgcaatatgactcatgtctgtaacaaaaagcctgaattattttacaaagctgcccaggaaaattgtttttatacctggtatagtaagtcctcacttaatatcacccatgggttcttgtaaactgtgactttaaacaaaatgactataatgaaaccaattttttaaatcaatgaaaggatgttgaaggaaatgacattattcagggacctgccatacatcattttgcttaaaatcacagtttttaagaacctatcaacagtattgtgtattatatgaaatgatgcacatttatgatttttttttttgagacagagtcttgctctgttgcccaggctggagtacagtggcacgatctcccctcactgcaagctgcgcctcccaggttcacgccattctcctgcctcagcctcccaagtagctgggactacaggcgcccaccaccacgcctggctaattttttgtatttttagtagagacggggtttcaccgtgttagcaggatggtctcgatctcctgactttgtgatccgcctgcctcagcctctcaaagtgctgggattacaagcagaagccaccatgcctggcacatttatgatttttaagctttctaaaaacttttgtagaattctgtttataaactatattagtccattctcaagctgctatgaagaaatacccaagactgggtaatttataaggaaaaagaggtttaatggactcacagttccacatagctggggaggcctcaataatggcagaaggcaaaggaggagcaaaggcacatcttacatagtggcagcaggcaagagagcatgtgtaggggaattgccctttataaaaccatcagatctcatgagacttagtcactatcatgagaacagcacaggaaaacccgcccccatcattcagttacctcccaccggttcccctcccatgacatgaggggattatgggagctataattcaagataagatttgggtggagacagagccaaaccatatcactatatgttactcaaaagctcagtagtagaaaaaaaaaaagatgaaaccaaaactgctccatttgccagaaggtccaagaacaccactccacatacccccactgccagccagatgcattctagggaggtgtttgaaatctctggtctaggtaccatcatatttaaagttatactggaggtatatcatcatagctacatttagtttttatactaagcttaaaaactaggcttctctcatgttgtttaatctttacagcaacaaacatgtattaatattaaaatgtattaaggtccaagagacttaatataataataactaaaaggaaataaacactgccagcaaagcagaataggtctcatttccagagctcaccattaggagtctgatcattattatcttaaaggcagagtgttttgaatgccatacttgtgcatatgaactttccttccttgtgtttactttagttcagtggttggtggacctcagtatgcataatgcgttgtggagttttatgtacaaaactatgtggaactgattttcagagcattgtaattaattatcaaggaaattttgacggagtaattttcagattttgtattatgtgctcaactaaaacttaatatctagaataaaatggaccttgccatatatcttctaaaaaaatacaatggttcagcagaacattcacctatatatatatatatacacacatatatgtgcgtatgcgtatatgtgtgtatatatatgtgtgtgtgtgtatatatatatgaaatttggattttactgaacttatctcattatttagagggccacatggtgatgaaatttatgaaataggtttttaaagctcccccttttttactttaaaattatttgcatagtaatcctttataatattagtatttactaatatggagtatttgttattttaaggagtttacctttttacagtcatttttggagggtgatgtaaaatgcattaagcacttgtacgatatataatcctaatttcttttttttgtttttttttgagacggagtcttgctctgtcacccaggctggagtgcagtggcgctatcttggctcactgcaagctccgcctcctgggttcatgccattttcctgcctcagcctcccgagtagctgggaccacaggcgcccgccaccacgcctggctaattttttgtagttttagtagagacagggtttcaccatgttagccaggatggtctcgatctcctgaccttgtgatctgcccgcctcagcctcccaaagtgctgggattacaggcgtgagctactgcccccggcctacaatcctaatttctattttaagatacaaatcatagtttcagccctaaagttatttagaatctacctaacacaacatgccaaatacatacagaacagctagaaaacataagtaataaaggcaagatgtgccacagagcacctgtgtagcaaaaaaaggagttgataaatgtagattagccacagaaatcgaaatcattgagctgtaatttttcagtgtaattttttttgtttcttaataggcagttaaacagtatagtgttcatacctctggtatgatgtttaacagttattttctcaaaattcagtagtcttttaaccagacaatgtttaattgtttatctgggaggtacctacaagccaaaaagtaagtttagaatgctgcttcaaagacataggtaaacagccaagaggaatactcttaagtccttataggaaaatatttaattcattttactcatggaagactattttatgtgcctactcagcaattaatagtgcattttaatgtgcttggtgatctatcacttacccacagatcagaggtagcaagtaactagcaaggaactgccaaagactagaacaatagcagaatcaaggattgacagctgatagcataggggaggcactgttcaaaatagaacttaaatgaataacattctaggtccatttagtaggaggacaagcaaacatctgcagaccttgagagtttaattggtaataatgacaatgctgtgagccatccaagaaatgttaagttaggttatttacactttattttcaaaatgcaggagatatctaatacagtctcataagcatcctttactttcatgtgtgctaggttatgttaatctttttacttatattatctaatttttctttaaaataaacctgggggtaggttttattacgtgtatgctacgtatgagaaaattgcaactgagtttaagcaagacatactttcacagctaataagtagtggaatcaagaatttgaacctgtttctgactaactgtaaaagcacatgcttttagctattatgttgtggttcatccatgcaaattaaattattttgagctttacaataattacactgtgctttaagtcaactattattatccccatttgagactcagaaaagttaagtagcttaaacaagatagtatagctattaagtagcagtagtaggattttgttgttgttagtgttaatttttttcccttgcctagaaaatgtactaataagcaacatttccaatactggatacattgggttttacccaaataattttaggattatttaattatctactttaatttttgtttacagcataggctttaacagccaagcttttcccatgggtttttttcacaaagctaaataactatgagacataaagagttttgagatcctctgtaaaggtaaaagataactataatgaagcacttgctacattccaggtactgttctaacatttcgtaggcattaactcatttaatccttacagttgctctagccctgttttacagtgaggaaactgaagcaccaagaggataaaaatttgatcaagcttacacaatcttaagtggcaatactggcattaaaatccagcagtgtgccaggcgtggaggcttacacctgtaatcctagcattttgggaggccaaggtgggtggatcacgaggtcaggagttcgagaccagcctggacaacatgatgaaaccctgtctctactaaaatacaaaaattagccgggtgtggtggcgcgcgtctgtaatcccagctgcttgggaggctgaggcaggagaatcacttgaacctgggaggtggaggttgcagtgagctgagatcatgccactgcactccaacctgggcaacagagcaagactcctccttcttggggggtggggggggaaagtccagcagtatgcctctggaatccaaatacttgtctgctacaccgtatataccgccttccccccaaataacttagaagcataagttttcaaacttacagtattgtctgcagaagctgactcccctaacctatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtaggtagaattcctatttttcataatatgtatatcaaaatatgctgtgaattcctttcagattaaagtcatatatgatatatagttgagatggaagtttgtgcgccacatgtattgtgatttttttctcataaatgagcatttaggttggagttcagtgattcacacaagtagtggatttatattatctgctttcaagaacttagttgctggtttttatatatgacttcctgaaccatctgatgcgcctaccatttttatcaagaaaaatcgaaaacacgagttatggactctttggttgtataaactgatttgggcatcacgaattgtatttatgtaaccttcaatgtaaaagcacaagagttagaggatttcctccaaatctgtgaatgtaatatgtcatagatgattctgaatttctgaattttattctggaaggctctgaggctgagccatttgtttttaactggccaggtttttaatgtaaatttatcttacagaaagacaattattataactttaactacactacagctgcttgagagggaaagcccatatgttcattgctgtttctgctttaaaataacagatggtagaaagttacactgtatttcagaagtcaaaggggggtgggggaggaaagtgaagggtttcttggattcttatttacagactttcagtttcctaattatttcaaaaaaattaaaaacaaattttggattcctctccatcctaaccagtaccaaaataaggcattctttttcagctttctcacttaattacttactataaaagtttttttcgctaagcatcatctctgttggtttttgcacttattattctttagtgtgaataaacatgagaataaactttcaaaagaggttttgctaaagatttctaaacagtttcaacagttactgaaagattcactcagctaatttactttgcattgtgggctatcttatgagcaagtagtgtttaaagaattacgatttattttgagatggtatatttatttgaggtgggattgttgactatagtgggcttactaacatcctttagtctcaccctgtgtggggtagctgggtgtgaaagaatggacttcggagcaagggatcagcatttttctttggcttctaccttccagtcagcattgtggccttgaaaactcccttaactccaaatatgagttttattatttgcaaaatgacaggatttatttctaaagtcctttttgtttgcatgatttaataaccttttatgcctattcaattaatgtagaggctgtaccctatgtttctgttcagatcagatttttaacttaagaaagatgcttttaatgtttttggattattgttccctctgagaatatattgacaactgtggactttttttccatataactgctcattcacccaaaatttataaacatttggagtttcagaaagttcatgcacttcctaaaacccatccatatactcacagttaagaactcctgctctagtaaaagtgtagtgataggaatgttggaacttctctctttgatggagttgagagatgatagctcataaatctaaagattatcctttgagaaggaagattgttttgttttcaatgggaagctaacagattttaaacaaaaatgcctcattgcctttggtaagcgaaatccaagagtatttggggaagtatgagaatgggcagcttttaattttgtttcttcttcttggaatccttcaacatatttactttagccaggtcaccactgggtattataggtagttggaaatacttaaatctcatttccagtgcttccgaattcatgaatatgtttccccacccacccccaaggaacttttctgttggttttgctaccagctgatagaacaagtttggaatttcaaatgtgtgaccaactataatttgttacacatttcattatcagctgtgcaaagaaagtgacaccagaaaattaggtgtgggaaatggctgaaaataaatttttgtaattagttttaaataagcattcagacgtattttggtaaaaaggaaatttttctttttcaatgtagtgagataaaaaaataatgcagtaaaaacatttcgtgtccttgatctaatgctttcaaggctaatatcttttagattactgcttttcttaaattgatgaagaaagaggttggtggttatgaaatgagtagttttacagtaatgcatagtgaatatagaaggggagaggacagattgcttagagatgtcttacaggctgtctaatgcagtcttaatcaatgtgtattttgcctattcttaccagtccagtttgtgcaagttaaaaacagaaaccaaaagtaaacatttagaaagcttataatatcgccacgatacccaaatgtgtgatacttttgtgctatgtaaaagtattggtccactaaagattggaaatgtttaaaatatttaaaaagtacacctttgccgtagcttgagaggcactgatctaatcaatgctgcctcctaaatctgggctttctgctctgtcccggggaaaatgtcctattagctctccttcaagacttttagtgattaagagcttcctgtttcacaaggcagcttgctttactggtggacagctctaactactagaaagttctttcttgcatttagatgaaatctgcctgcctgcagtggggagattctcaaccttttcccacttacacacctttcagtaaacacgcagtattctcacacttccttattagagtgtttaagtcaaaattaaatattgggatcaaaaacaagtcaaagtaattatactgttgaatggattttctctaattattctcattgtaaagtaagctaatttttatctgaagtcctgataataatatattgtaatttcttacagtatattacatttaaaaatgtgttctaaatatttagaaagagataatctccaagagtcagcatggattcactaagaaaaggtgatgcctaattaacttggtttttttttttttttgatagatttactggactgtttgttttggagggttcatctttcttttcccttcatttcagcattttagatttaaggctttgtgttaactaatttttttggtaaagagaaaattttgttttatgcattgattttccttgataaatgctgagatccttaaaagtgaagaacgtggcttactcttctttataacttatatggctgacacatcataaactctaaattcgtaagtttttttggtgagtaaatgaataaacaaatggataaaaacaaggcaaacacttggtaggtaaaacagaattggtagtgataactaatacattaaataatttcttagattagattgataggaaacaacctgacactaatcttccatttattcaaaaattatttatttagcacctactatgtgccaggcattgtgctaaatcttaagacaacttcaacaagacaattagatctctgtccccgtgggatcatgcattctaatggaggagcagacaaaaaataagtaaacctatttcaagttgtagcaaggcgataaagggtataatgagccaagatataaaacacaggagagaggcaactttacataggatgactgggaaaacctctgtgaggagatgtacaggatgagaaggagctagctgtgtgaaaagtggtaaacaaagtaaaggggctaatgtgcaaagcctctgagggagtgtgcttaaggacctgaaggaaaactagtgtgataggaatgtaataggcaaatggaaagatagcatgagataaagtggtacccagatttttaaaactaggtatgtattatgataatgaaatactgtaggttctatataagattttaactttgttccaaatgcaaagggaagttactgttaacttttaaacagtagagtgatataattcagtacaccttttaagaagtcatttttctttcatcgtcaatctctatttttgatttttaagtatactttaattgaagtgtaatttatgggcagaaaagtgcacaaatcataactatattcctttttcactttgccagcctttgcactgatggtgtaaaaatattggtgggtaaaactggtggtgtcttaacattagtcaaggcagtgacaccagtctatccatatatatgcatatgggaaaaatgaatcatgtgatgccatatgcaaaattaattcttaatggattataacctgttaaaagaaaaacttcagacaaatttagcagagtttatttgagcaatgaatgattcatgaattgggcagcactcagaaccagaagaggttcagagggcccccttaacagcataagcagcaagcttttataggccagataaagaagcaaagtagataaattacctgattggcttcagctaggcatctgccttgttttgcatgggcatggtatgatgaaacatttaccttgtttgagcatggtgtgatgagttggctgcttgtgatcagctgaaactatctgtttgttatacttctaagttgggtttcagtttgtgtaagtactaagttaggttgtagttcattacgtaggaactaagtacagagacagccccaggctaatggcatcctgcttatttaatttaacaaacctaaatatgaaaggtaaaactaacttccatattaaaaaaaacatagacttaggcaaagatttcctatacatggcataaattaaaggggaaaattttgcctctattcatgaaaaaaactaactggttattttgcctttttttgaaagttgacagatattgttatcaaggcgctctggcctcttaaaagaaattgggcagcattctttactttctgaacgtttgtgtaagattagtcttctttctttcttttttttttttttttgagatagagtcttgctccgttgcccaggctggagtgcagtgttgcgatcttggctcactgcaaactgcgcctcctgggttcacaccattctcctgcctcagcctcctgagtagctggaactacaggcgcccaccaccacacctggctaatttttttgtatttttagtagagatggggtttcactgtgttagccaggatggtctcctgacatcgtgatccacccaccttggcctcccaaagtgagattagtcttatttctaggtatttgtaagagttcacaaatgaagccatctgggcttggagacttctttgtgggaaggtttaaaattacagattcaatttattttattttttttatttctttattttttatttttgagacagaatctcactctgtcacctaggctggagtgcagtggcacgatctctgctcactgcaacctccacctcccgagttcaagtgattctcctgcctcagcctcccgagtagctgggactacaggtgtgtgccaccacgcctggctaatttttgtagattacttagtagagatggtgtttcaccatgttggccaggctggtcacgaactcctgacgtcaggtgttctgcctgccttggcctcccaaagtgctgggattacaggcgtgagccactgcgcctggccaattcaggttatttaaaagatacacatctctttcacatttttcatttctccttaatatcatttttggttagtttttttcttaggaatttgttcatttcacctaaaatttcaggtctattgttacaaatgggttcataatatcttcttattaccttggtaatgtttgtaattgcattgttaagccacatttttattcccaatattagtactttatttgtatcatctcttattaatctgtttataaaataattttttgcatcattgttatttcattccttccactatctttgagtttatttgctgttctttttctaattttttgaaatgaatagtcagatcactggtttcagctgtcattcagttcaaaatactgtaattttcattatgattttttttctttgacctgtgtgttatttgacatgcattccctcattttttaacaatagagggttttgtagttatctctatagtattgattgctagcttaattccatttgggaagagaacatactctgatttcaataatctagcatatggtcaattttgggaaaaatttgtgatcacttgaacagaatgtatattctgcagttactctatgcaatgttctagatatgtgagtaaagtttgttgactgtattgttcagatcttctgcattcttactatttcttgtctgcctactccattatctgttaagataggggtaaaacctcctacagtgattgtggatttgtctgtttcttcatttagatttttttgcttatggtgaaaaggattttggggacaaatgatttaggattgttaaatcttacatatggatttctcccttgttttaaatatctctcatgatttatagtactgctttttgccataaagcctaccttatcgaaaatatgtatagctgtaccacctttcctttggttagtgtttacatggtatatcttttttccatctttttattttcagcctttttgtatctctcttgttggtttgtctcttccaagcagaatgcagtcattttaagtgtgacaattttagacttttaatgtaactattcagtccttttacatttaatgtagtttactggtatttgaatatatacatatacacacacacatgtgtgtgtgtatatatatatataaatgttactttttgttttctatttgactcacctatattcctttttctgaccctttacttttagctggttctgttttttaaaaattttatacttttttctttagtaacttgatagatacatttttttaaaagaccatttattttgggaggcctgggcaggaggattgcttgggctcaggaattcaagaccagcctgggcaacatagcaagaccctttctccagtaaaaatttaaaaaaattagctggacatggtggcacatgccagttgttccagctacttgtgaagctgaggtgggaggattgcttaagcctgggagatggaggctacggtgagctatgatcatgctactgtactccaacataggtgacagagtgagaccctgtctcaaagaaaacaaaactgtttctttagtgactgtccaaagaatacagaatactttcttgacttactacagtctgaaataaaatattactttggccactcctaaagtaatactgggactattaattttttccagttcattgttctttcttctacactgtctaatttcctcttaaactatctattaagctcttaatgtcatttctaaaatttccagttgattcttttttatgaaatccaattctctgtaaaattctctgtaattttacgtatcttttccatcttccctctgttttcttaaatatattacttatagttatttggttttcaggccttctgtttgtatgcaaagtaatttttttgaatgccatacattttgtatgaaagcaacagttttcaaacttttttgtctcagaccgaaaaagactttatatggattctatctgtgagtatttacaataatagaaattaacactgaaaaattgttttctttttatttttctttttctttgttttcattgagacagggtcttgttccattgcccaggctagagtgcagtggtgtgatcacagctcacttcagcctcggcctctcagactcaagcagtcctcttaccctagcctctcaagtacttgggacaataggtgtgtgccaacatacccagctaattttttatttttatctttgtagaaatggactctcactatgttgtccagtctggtccctaactcctggactcaagccgtcctgccaccttggcctctcaaagtgctgggattacaggcatgagccactgtgctggcctaaaactgagaaagtttaaatatatttacctattaattcattttaaaatattaaacttcttatatattagtatagataacataatctttataaaaatatatcttttccacaataaaatttttgaagactaatgagtaaagtgacattgttttacatttttgcacatctcttttaatgtctggcttaacagaaaataccctgatataaatatcaacctctacattcattctgttgtgatatgttgttttgtttaaatgtatgaagaaaatacgacttcacacaaataggtagttgggaaaggaaagagtattttattcatcttttcaaataattgcagatattcttccttgctattaaaccagaactcaacaagtggtagcttcttaaagattagttgcattttggaacctgaaaccatgccaatgaactttcaaggtctattatattaaaatctattggtctatcttttactttgaatttttttttcccatctgtgattttgtaacgtcattcattggtcaaatactgcttcactgagagttacaaatcatccaaatgttgatgtatttcattttatcagtatttctaaagatgtggtccccacactgtcagcagcttcccctgggcaattgttagacatgcagactcttaggttccaccctagacctacttaatcagaaaacctggggttggggcccagcattttgtgtgttacgaagccctccagttgattctaatgtacactaatgtttgagaatcaccgctctaagggttccagctgggtttctggggtgttcagtggggtccctatgcgtggcaggttctgatctctaatcgcagtctccttagcattttgaaacttccaaaaactttactatgcttttcagaagcttcttgcttttttcagaaactttctactttgcttctaccctgtacaagttcagaatttggtatatacttagagggaaaaatcagctgtgtatcaggctctattttcaaacttgcctttttcagttgagttctaaatctttgagtctacaatttttgtcttagcagcttgtgagactgcaagaagccttgcctgcccccagcagcagccttcttgtgtccattgcccatacttctaatttcttgcgttccaccaagaatcatcaaataatctaagggaaaaagcaatttcagaatgtcattttacctctaaatttcctccccttccggaatctttggaccctcaagccatagttttcttagaagtttccctgtaacactaattcaacaggtggggttttttagtggttgtttcatttttgtagtgagttttgactggctttttttagttgcttttagtgtgagcatctaacacactactccatcataaccaaaagcaaaagtacagaaagttacttttgagacagtatgacaaattaattggctagccagtcatccaggaggctggtacagtaatatgagtgagaaataatgatgacctagcttaggagggagacaagaaagtgaatttgagatatgttttagaaacagaagcaacagttactgctgcttgatttgatacaggaaatttagtatttccccttgatttctgagtcaaaaaattaggtagatggtggagctatttactgaaatggggatgatctagagtggacaggtgattgtaaacaggtttaggagaaaagaaatactgtgttgatgttaaatgaattagtcagtagattgtccaagtggaaatagagaataggaattgaataaatgactctagagttcagagaagcagactggacttaagaatcatcaatataagatggtgttgaaaccaaccttaagaggtcatggaaagtgaaagtatggataagaaataggaggaaaaaaccccgaggatccaggtctaaggaaccaaacacttatagatcaagttagaaaaggggaaatcatcaaaggagacagaaggaaaaaaatgtaaggagaaaatgataccatagaagctaagaaaggaatatatttaagggaaccaagtgatcaactgggctgaatgctgctatgagaaccattaaaataaggatagagaggagggtccagagtattttttccacactggaagactttgatgaccttaaaaaacagttttaattggtgcagggctaaggaatgaaaagatgcggaagttgagttagcttatatacacaactattttgagaagttttgtgaggaagaggaggagagaaatggaatattgtctgcaacagagggatgagtcattaagggaaaaatgctgttttttgttttattttgctttttacttttttttttaattataaaagcttgttgagtaatttttagcaggtttgtttgtcagtggaaatgatcgagagaaggtgatttagaagagattaaattttgggggaaataaatgtaatgttttaagtctcaaaagtcaattgtataactgtgggacagagatttggcagtgtttcacatggaaaagagccatgggacatgtatttgatctcaaggcctgtaagattcaacagcataaaagctgctaaaaattttatgcagtcctaagctgcataaaggacacatagtatctttattaaagaccaaatattactgcaatcctctatttatttgttatgcattcattcaattaatatttatccagctgtactgagctaggcatttagatcttatctagaattttgtgtctgtttctggatcccagattttttatggatactgacaaaccaaatagtattcagaggaaattgaacaggatcatgaggtgtctggaaacaatgtcatatgagcaattattcattcaacaaaatttactgagtacttaatgtaagccagataatgcactagatactgaagaagataaccaaagaccttgctgttaggaatcttatattccactgtgagagacaatagtagataggtaattggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaaaggctgatataaaaaatgcccatgatgtcatggatcataagtgctttgaagaaaaagcagagcatgaggtagagaatggcagctggaggggaggcggatgctgatttacttatagccttcttagaaattctctctaaggagataatatttgagcagagacctaaggcagtaagtcatgcaaaatgaagaaagaatatttcaggctgaagaaacaccaagtgcataggtcctgaaacgagaacatatggtttgtttctggaattataagcagatcagctggagcataggaagcaaaagggagagtggtaggaaatacaattggagaggaagcccaaggctaaatgatagagtggcttgcaagccatactacaaacttcaggttttactgttgggcattatgggaatgctattacctgttatgcagtattaggaagactattttggcagctatgaagcaaatagggagtcaagagtggaagcaaggcagtcactagagaaaactgtagtaatccaagagaatgatactgttttggatgagggttgttgtagtagaggaggtaaaggggaaaaaaaaaggtctaggcccggtacggtggctcattcctgtaatcccagcactttgggaggctgaggcggggagatcacctgaggtcgggagttcgagaccagcctgaccaacatggagaaaccccatctctattaaaaatacaaaattagccgggcgtggtggcacatgcctgtaatcccagctactcaggaggctgaggcaggagaatcacttgaacccgggaggcagaggttgcggtgagccaagatctagccattgcactctagcctgggcaacaagagcaaaactccatctcaaaaaaagaaaggtctaattcaaaatatattttgaaggaacacccaacaaagcttatgaatcaggggtaagaaaaaatgaggaaagatcactcctgggtttttggccaaagcagtggttagagaaaaagaaaatttgctatactgagaaacttagaggggatctatgcaatatcaaatacttaaaatgtggcatgtatatgtgaagtccctcttgtatgcctctatgaggacagaattatgttcactgagaagaaactctaagcagtgaaaatttgacccctataaggaagacttttcttctagctggaacgtaagacatcagtcagctagtaattattgaggctttctggaagttggtagaacagggtactttctaggcactgaagctacagcagtggaaaaagtgatgtgcagatagaggcagcaaaggtaatttgattgaaaactactagagagcaacttattagggatgtcatagaaggaatatatttattgggtaagaggtagaacctcttcagacccttccaactctgggtttctgtgattctctaatgatctgataaaccgaatcagactcaaatatttttcttcagatccccttgtctctacattatttaatgctatattgagataccataccatacaattcaattcatccatttaaggtatacagttcagtagttctggtatattctcagacatgtgcaaacatcgcactcaattttggaacattttgatcacctcaggaagaaacccctttagctattgtcccctcatcttcctgttctcagttcagtttcattgatcagtctgtctgtccttgtcctagtaccacactgtcttgattactgttgctttgtagtaagttttaatattgtgaaatgtgagtcctcctactttattcttattttgtagaattgttttggctattatggtccttccataataattccatatgaattttagaaccagcttgtcaatttctacaaggaaatcagctgagatttttgataaggattgcattaaatctgtaaattagaatggggaattttgccattttaacagtgttaagtcttctgatccacagagacatgatgtttttctatttatttagatcttccttaatttctttcaacagtgttttgtagtttacaagtctgagttttggacttcttttgttaagtttattcctattttattctttttaatgctattgtgaatggaattattttataattttattttcaggttgtttattataaatgtatagaaatacaattaagttgtatattgatcttttatcccacaaccttgctgaacttatttattaggtctaatagttattggtggattctttaggattttcagtatacaagatcatgtcacctatgaatagtgatagtcttacttcttgctttccaatctggatgtctttttcttttttaacctcattagactggcttgaacctccattacaatgttgactaggtttattaagaacagacatccttgtcttgcttctgatcttagggaaaagcatccagtcttcgctcattcaatctgtgggttttttgtagatgctttttatctacaaacatactaacacttagagaacgtctgtctattcctagtttgctaggtgcttttttcctgaaagtgtgttgaatcttgtcaaatgctttttctccatgtattgagatcattatgtgaatttttttttcttttgatgagactcgatatatttattttttggtggttaaaccaaacttgcatccctgtgttaaatcccacagggatttgcaaggtttataattcctgcatcccttggttggttgtggtttataattctttttatatgtttatatattctttttatatgttgctgggtttggtttgctagtattgtgttttagtatctttgcatccacacttataagatatattgatcagtagctttcttatgatatctttgtctggttttggtgtgaagataatataatgtaggctttataaaataaattaggaaatgttctctttctctcttctataagccatcaggggctgggcttttctttgtgggtagttttttgtttactgattcagtctcttgttgcaggaatattcaagttgtctcttcttgagtcagtatcagtagtttgtatcttttaggagcttgtccattttctctaaattatctaatttattgacatacagttgtttctcttctttttccattgtcttaggttgaaggttaagttattgaagtcttttttttttttttttttttgaaacagggtctcactctgtcacccagactggagtgcagtggcacagtcatagctcactgcagccttgacctcctgggcttaagtgatccttccaccttagcctcctgagtagctgggactataggcacatgccaccttgctcagctaatttttttattttttgtagagatagggttttgccctgtttctgaggctggtggtctcaaattcctgagattaagtgatccgtgcccccctcaccctcccaaagtgctgggattacaagtgtgacccactgtgcccagccgtcttcttttttaacatagacatttatagcaataaatttctctgcactgctatcgctgtgtcccataagctgtgggtggtgttattcatgtttaatacattctattattgtcggagaatacagtgtattatttctgtccttttcaacttattaaggtttgttttgtggcctattatatgctctgtcctggagaatgtcctctgtgcatttgagaaaaattgcgtattccattattgggtagtgttctgtaaatatgtgttagttcttgttagtttatagtattaagtcttctgtttccttgttggtcttttgtgtggttgttctgttattgaaagtggggtattagctggtatttattcttcatttcttagtttctgtttttgttttggttggtttttgcttcatatattttggtgctctattgttaggtgcacatatgtttacagttgtcccatcttccaggttgattggcccgtttttcattatggaatgcccctttttgtctctaataacatttttggtttcaaagtttactttgtctcattagccactctagcttttcagtgatttgctgctgtcaggatatgtctttttccatccttttacttttcagtatttttgtcttcaaatctaaagtgtgtctcctgtagagaacatatagttggctcatgcttgtttgcttttcttcaatttttaatagaaacagggtcttgctatattgctcaggctagcctcaaactcctgggctcaagtgatcctcctgccccagcctcccagagtgctgggattataggcattgagccactgtacctggctgggtcatgttgtaatttaatccggtgcgacagcctttgccttttgattggattgtttaatcctttctcatttagtgttatgatttattatttacttttatttcagtagttttgggggaacaagtggtgtttggttgcatggaaaagcttttttgtggtgatttctgagattttggtgcactcatcacccaagcagtgtacactgtacctaatgtgtagtctttcgtccctcatctcccttttctttcttccccctaagtctccaaagtccattatatcattcttatgcccttgtgtcctccaaagtccattatatcattcttatgccctttcacttataagtgagaatatacaatgattggttttccattccggagttactttgcatagaataatggtctccaattccatccagatagttgcaaatgccattattttatttctttttatggctgagtagtattccattatagatatgtaccatgttttctttatcctcatgttggttgatgggcatttaagctggttccatatttttacaattgtgaattgtgctgctataaacatgtgtgcaagtgtctttttcacataatgacttcttttcctgtggaaagatacctagtagtgggattgctgaatcaaatggcaggtcttttagttctttaaggaatctacatactattttccgtagtggttatactagttatactcacaccagcagtgtatcagtgttcccttttcaccacatccatgccaacatttataattttttttgattttttaattatggccatttttggaggagtaagatggtatggcattctggttttgatttgcatttccctgataattagtgatattgagcatttttttaatgtttgttggccatttgtgtatcttcttttgagaattgtcttttcatgtccttagcccactttttgatgggattatttatttttttcttgctgattggtttgagtttcttgtagattctgtatattagccctttgtcagatacacagtttgtgagattttctcctactctgtgggttgtctgtttattctgctgattatttcttttgctatgcagaagcttgactgaaagcttttattatgaatgtgtgttgaattttctgaacttattgacatgattatgtatttattttggctgggcgtggtgattcacgcctgtaatcccagcactttggggggaggaggctgcagtgagccaagatctagccattgcactgcagcctgggcaacaagagagaaactccgtctcaaaaaataaattaataaatatatatttattttttattaatgtggtaaattacatcgattaatttttgaatgtgtaagccagtcttgcattcctgagataaacctaacttggtcatcatatctagtctgatttgataagtgagtattttgtttgttttgcacctgtgctcatgagagatctgggtctgtggtttccttgtgacattttcattagggtttgttatcaaagatatgccagcctcataaaaagagtttaaagtgttttctttctcttctgtttttcggaaaaattcaacaaaatcatggccaggatttttatttatgggaaggtttttaattacatatttagtttcttaaatattcttttgattttccatttcttcttatattaattttgaaatgttttctttttcttggaatttatcttttacatttttatgtgctctgacatgaagttgattagttttttagagaactaatctttccctgtgttgattctctctcgaatgctaatttctattgtgatatcttccttgacgcatgagttatttaggagtatattgattaatattctaacattgggatcttctatatgtgtttaattctactatggtcagctaacagactccgtttcaatgtttctgaaactctgtgttggaggactttgtttttttctctcaatctctggtgaactgacagcttttgtaaaatacaatgaaaatgaaattatgagaaaattgaagaaaaaagtatgtatataagatccaggttttacaggggtacactgttatttcaaacaggtatattttctaaacacttaatctcaatttccaaacctatctatggtctaatagcagttgtaagtcaacattcatccatggaacacactttaaatagcaccgtttattgttattttaatctttgaagtttgtcgagacttgcttttagcctagcacatgatcagttacagtaaatgttccatgtgcagtttaaaagaagatatgttctgcacttgcagggtggaatcttgtatgtgtgtcagttaaatcaagtttgttgatgttatttaacttcagtgttcttactctttcattttgtctacttgttttatgcattattgagaagaggcatcactcactaaaattgtagatttgtgggtttttccttttggttctctccttttttcctttgtatattttgaggctatcttattaggtatattcagatttacaattgctttctcttaccagtagactgacccttgtaacactgtgaaattggctgttttatttttgcattttaccttaaaatgtactttatctaataattagtataacaatgtcagcgttatttttgatagtgtatatttttttctatttcttaaaagtatagtctcttataacaatatataacctgctggatttttattaatcaactttattgagatataatttatatagaataaaatgcacccatttaaacgcacaatttgacaagttctggcaaatatatatgtgcatgtaatcactaacagtcaagacatacaccatttccataagctccaaaggttcctttttgccccttcccattgccaatccctccccacagcctgggcaatcaccattcttctttctgccacagactatagattaaacatgtcttttctagagtttcatatatatctggaatagtattatatactcttctgtgtctggcttctttgaaggaaaaaagcagtgcagaatgttgggctcatcatagtgcatttccgttatctccaggatcttggccctcaagacctgactgacttggtagccctccagtgcttttatactgatgtgtttatattttatttagctcttctagttgggtgtcagtgggagagttggccttaaacatgatggttcacaatagccagaagcagaagacttctggccatatttagtggtagaagtacaaagatacagaaatactaagggtgaaggtgagtgttctaattaaatggaacccactgaattcccctagaaaactgagaggggttgaagagtgttattttttttgttctttttcttttcttttcttttctttttttttttttggagatagggccccaccctgtcgtccaggctggagtgcagtggtgcgatcaagactcactgcagcctcaacctcctgggctcaagtgatcctccacctcagcctctccagtagttcagactacaggtgtgcaccaccacacccaactaattttttaattttttgtagagacagagtcttattatgttgcccaggctggtctcagactcctgggctcaagtgatcctctcacctcaccctcccaaagtgctgggattacaggcgtgagccactgtgtccagccaagagtattttgttttcattaaatttagggtatgcatcctatcctatgttatcagtcaggattcactgccagcaactagatattataaccaggagagcatttagtacaggttacatattgttggaagatctgaaggagcaagttctacacttggcctacaagaatcattcctaaacaattacagagctactctgtcagggaagctgctgcctcacaggctgccactagaactgtgggagaagcacagttgctgccaccactataccacactcttgcttactagtagtaataatgataaagaggtgcagcaagaaagcctttctctcatttcagccttccaagtcccacaagaatggctctaattaatggaacctaatgtgaatcaaacactacttgaagagactataagaattgtagttttggactgaggaacttttccaactatttagaggtagaatgagggtcaaaagaaccagtccaaaatgtctaccatgtacataaattaaaagccctctaacttagagtgagtggtagagaattcaacgttattctgaataaattgtcatgtcatttttttcctctaacattgctatcaataagtataatatttaataagactctctatcatctgtgcctttgattttttccaactgctgagtgagcatagtatggcctatgatttaaatatccataatgcatatcaattaaaggttatgtttaagttcagttaatattttaatatttgctgaggatatccaagacatcgaggacatcaccctgataactctaagaatttaaacagcttaccacattgacattacctaattcctgattgctagattgtcttcaaagataatcatgaaatcaacatatttcataaccaagtgctttaaacttttatcagctttctttgtaactcttatagcatattcagggacatactatgatatattccataagtgtttatagcaattcagatcttgatatgaaaatgtcagttgtatcctcaagggcaaagaggtaaatatagctttctccagcattaccccttctaccacaacaccatgtttgttgatctattttctttgctttcttttcccttcataagctgggtggtatggtatcaataaaaggccagaaaaaagtcagaacaatttacaccaatactagctagatgctttttggtttgttgtaagctactgagaccttatgatattttcagcagctatagatggtttgcacttaaggggagaatacaaaataaaaaacacaaagagactggtgagctgtaatatgattgttagtctaagcattaaacaatgacagtattgaggactagaagttagaaggtatatgatgtttagctttcatgtgacagtttggtgctagtatttttgtatgtaggttctgtttgtgatttacaatgattctgcatttgaaattcacctcaattttcctcttgctgtttgcattagaaagaattcattgcaaagaactctaaaaaagaactgacttaattttattttttgcactgtaaatccaaaactacactctgtaaatattcgaatagaatcatttcagagaacaaaaaaaattttttgacattatttttatctctcatttattaagattagatcatttatctctattaagtaaataggtttttggcactgggtagtatatagttgcctttttaaacatacattttatttttgtgacattataagacttgattaatactttaaaagaccccttggattgatttaccttcttcaaaaagatacccgttttcacagatgaatgtgtctttaaaaaaaaaaaaacagtcatggaaaagactgttattttacttgcctaaccatccacttaattttagaaaattctctggtcaaatacttgaaaggtgaatgtctgaccagtgcagtagttgaatgttgttcaagttattcctgattataactttctttcatcatttttctcagaggtttttttttattgttgggtagttgtaggacttcactaatcaagtttaatttatactgttttgatttctagttagcttataaaataatttgtcagaggattaatgtgtgagacaatattcaaaaaagagtatttttatattttggggactttaaagtatgtcaatgatgaaatgtattttaattcatttttctttgttctctcaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaataaattcccatagcactttattcttcacatggtacataactataggggctatagcttggtaccttgtgaagcaactcttggtgtaacataccttatttctcatactaaaatgcaagaacctttagagcaaggatcttgccattcatctttgtaacctctttactctggagcacttgcatttagcaggcatcataaagttttacgtaccaagaaaatgttgctgttttctgaatactatgcatcaaaaaatgttaccactaatttttaaagctctgctaaggaatattggggcaccctcagatgcaccttttaattgatgtcatattttcctaatccatactttattcatgagaatttgagtcaccccagcattagcttggaatttccttatttcccatttgctttgcaggtgccttggagtcagatctggttttgaatactatcttcctgttatgtgatcttgggcagttacttaattttctagtcaataacccgtatctataaaatagagaaaataatcctacacaccggggcctgttgtggggcggggagaggggggagggatcgcatttggagatatactaatgtaaatgacaagttaattggtgcagcacaccaacatggctcatgtctacatatgtaacaaacctgcacgttgtgcacatgtgccctagaacttaaagtataataaaaagaaattttaaaaaatcctgtcaaataaggttatagtagagaataaggatgtgtaaagcatttagtcacgtaaatgcttaaaaaaatgtaatttttacttctttcactgcctcatttaattagttttatctttaataataccttggattcagggtaaagtttcagttatgtcccagtaatcatttattttaccctcgaatctgcaatttggatagaacatggtggggacagctcgtctctattccttgcagcattaacaggctggaggcaccacttctctggccagcaagttgggcctggttgttggctgagagcctcagttcctttctgcacaggttcctctttacataggcttctcaacagggctactagagcatcgtcaccatagcagctgtcttataacagagagtggtcggtctgagagacaaaaaatggaagctgccaaattgttctgggtctggaaactgtcagggcatcacttgtgccatattcagttggcctaagaattacagagcctgcctcgattcaaagggagaggatagagaggactgaaggaatcagtgctcatctttaatatgcagcaggacaggtttgggattttttttcccccttgagtctgtgaaggcattacttaagaacaaagtcaggcatgtataattgaactacagttacttgaaatataagcccagaaagtttcagataataaatacaactatttttctgctgttacccttgtacctaaagatgccatcctaatccccagatctccacaactatacctacatagtagaaggttaaaatgtatccctctttttctggtgcatccagcaaaagtaatatcatgaattatgagctctctgagagcaaggatcatatcagtcttgtttattgttgcagtgaacaagtacagttgcagatattcaggagtaattatctaaatggcagtaggcttataaaactgaattttcaccagccacaccctccccccaactccttatctgtaaaaagcttatttgagtggttacctgtcttcagtaaagattgcgcttgcatatttgctgtcattgcatattctgcttaattaagctctgttgatattgcagtttctgtgcatacttacatcttagatgcaatctgagggcctaggaaggccttttaaaaataaaacaattccgattgcagagaaagtgtaagtcaaggacagttaattcaaggggaacatagaaagctatttagattttagttgatggtgccagtcttcagcgtaaagtcaaaagtggagggaagtttagtaaggaaaaaatgttgggcttggaatacattgtttagtcttcaaagcactttactttttatgaaatatattttagacattcagcaaatattgaatacttactatatcaggcagtaaagatataaattcattcttaaaatgtgcaacatgttcaaactgaaaaaaatacattcttaaacaggaaactttttccttcatactttttaattaacaagacatataagagttgcattaatgggcgtgcttatgattgatcacccagcagcatcattagaaataatatattttattcatgtgcagaaatcttttggttgtcctggggaaccttgaacacagaaaagagcttttattgataaggtaattgaacacacttgacaattagcttaatatggtttaataccatttgtgggagaagatgaatcagccaggctctttacgtcaagaatatgaagtttctcttgagtcaaccaacttaagatgagctacggagactgcagtgaaaagttaaatatccaagtacaccagccaatttcacacagtggaaccatgctgtcctcgggcaccctgcacctcgcccaacagtcatcaactagatggaggctcctggctgcaaggaggatttgatgggaatgagtaaatgtgtcagcatagtccgtcccttctaatggaaaagcaacccaaagagcaaatcctattaatggctggatcagtatcatctacttgtcaaaaacattccatgaattatgagtcaaaattttatttatggtggcattacacacattaagagatgaggacttctgttagcataatttattagctggaaaagttgagaaggttctctggactcatttttataggtggaacctaagtgatctggataattgcccaccagcaaaattgctgggcatggtggacaaagaaaatgttccttctaatgattttttatgagctgagtagctattgttcccagctgagtgctcttttcctctttttattgttgctgagcaaaagaatttataaaaagctctttcttttgtattaaaaaccctgctcaattgaaatgcaagttcattaagtaatcttcatttctcttcctgccataataaccctttccctctctgttcgattcaacagtatctagcagcactgctccaaattttaagtctgaacagactatattacatagatgtagagaaatactcaatcttcagcattaagagggagcttaatttcacacgggtggaatatgatcactcaggctagatgttggccataaatttcaaattagtatctcaacttagcaggggggatcaacagtggcaaacttcaattatgacaggataaaaatcacatagagatattggttcaatatggacatctaaactataatgctaaaagccaataattagaataagttcattttaagaaaagcattaataatattagctaacgtttagtacctgtgccaaacattctacctatgttaccttgattttcatagccagcctaagaggtactattatgtatccccattttacaggttaagaaacaggctcagaggagtttaggatcttttccaagattacatagccagtaagtggtggcactaggaaccaaattcagactctgaatcgcatgctgtttatattatattgcactcattctaaatatgtgggaatcagaatgaaggggcttgtatgacttttggctcattttttgatgcatgtgacctgggattataaatgtgaaattaggtttacgaaaggatccagtgtcattgtgcatcatgggcaaggagtacctaatctctttaattcttccctggaagcttacgatgtccatccaagtgcacatagcaaaagttctgttgtaaagtttagcagagtgactttctttgactcagagtgatgacggaggaagctttgataagattttatctgaaatgttcatggacaagagctttcaaggagaacatccagagcaaggttctgaagacagctcatgaaggtgaagcagcagacctggcacaagaaatgaagagagagctcagtgtattaaagatgaaaacaagaaaaccgaatatattgaaaggagcagagaggcaatgaaaacaagacaactgaaatgaggtaacttgcagcaattgaaagggaatttcagtacttttatagaattcttaaaaattgtttcctgctgtttattttcaattttgaacagggttatttgtccatgccatactttttttgccaaattccaaaattgtgtatagttctatagttgtctggtggagtcaatggaactttagttaccagtctaagaatgtgtctttgagattgtccagttaattctctatttccagtagctgtaataaatggtgaaaaggtttctgactcctggagaaagtttctaactccttatgactaatattcataacagacttgtgagttccttgaacatggatacacctatatgcaagagtgtattccaaagctaactcagtgatctttccatttatctattcttggattagtggtgcctttgctctttccttctgtaaatgtgaatagttaagagttgactgcagaagtgtttacactttggcttccatgcctctggaatgtttgtgctttggtggtgagatgtgagactatatttgtatagtctgcatctctcaggctgccccagaatgttgtacagtgcagtgctgaagaaagcagcaggtacacacagaaatgcagcctttcctggttaaccctgcttggatctgagttacactttgtttcctgacttcttgggacttaggtaatcagtttgccttctactctatctcattttgtactcgcttacatactacattcttgtttgggctttcgtttcttcttgtaagcagagattttttaaaatccaatatgtgaaaatacggatgcactacaattaaataaataaaatgctgttgtgtttgttttgctttaaaattgtaaaggataaacaataagatagttttatctatgtggttttcccgatgcagttaaaataaaacctaatctgctaaaattgaatttacactcaatttttctgttgtataattcttgaagaacacctcatgtgttgtacaacttcatctacattgtgaactcttttatttattgaaagtctatcttagtctttcactttttctacacttccctttacttcctcatgagatgctcagcccagttgtccctcaggacacagtatcgattggttcacttttaaaagcaactgttagaaacccaaatcatagacatgtgaattttctcagaagccattattgaaacttggatttttacctctcataccaaaataaagaagggaaaaaatagaaatcagcccaacaatacttttaaattgatttttatatttatgttgtaatgcaaataccaaagaaaagtgcctagttccttggtttatttacttatatcttgcctctgttatcttcatatcaatttttggccttagcacttttgactgcataaagaactctaaacataggcaatggtaatagaaatgctgacacatctgaactgtcaggcccagaatatattattgaatatgactgcacaaatgcctggaacctatacttagcgtaaagaataaggctgctgttttcaacttccaacaggaggagagtacagacatatgtgccctctgtttcccctctctggctctttcattgtctttcccctatgtgtgcatgcaggcaggcacacatacaaacacatcctgccccatgaagtggtcacatcttaatatctactaaggccagttagacattctgtgggccgagtgtatgttgcagttgcttaactggcctaaaggtctcatgatatcatgggcactatcgagtgatgtttccaaatctgtagaaggaggaggactggtagtgttgggcttgcataacataaagggcctgtctaccataaaacaggagcttggatttgtttttttcaggagatgaatatgtttttcacagcagtctagtgaattaagaacaatacacagaatcccacagcgagcgtgttctatttgaatctgttgatgggatttatgtatggaacaacaattttctgtatagacataattgaatacatattaccatgatctgaaaccatgcaagaatatgtatggtgtgtgggaaacctgaagacagatacaactgatgaaattattagtttacattttttattcaaaatatttgtgaagcagctattccctacatatgctctatgtagaaatgcagagacaagtagatgattataatgtgtcaccatctcttttttggactgattttttttttttaaagacggagttttgctcttgttgaccaggctggagggcaatggcacagtcttggctcaccgcaaccaccgcctcctgggttcaagcgattctcctgcctcagcctctcgagtagctgggattacatggactgaatttttaatagagcaggaatgccaaaagggaagtccctcagatctggtgtgtggctcaataatgcgctcagttccatgcagcttcttcccttagggctctgagtaaagtctctggtgccagaaggtatgagggtctcttgtatttaataatatcaagggagtacagtgttttccctcaaagcctggccagcagttactcctggagaaagaagaacaatctggttgacaaatgtgtcacccatgtaaactcaccagaaatatctagagccatgaacacctagtggggtcagcaataggtcaggcagtaattgctcagtgcctcgttcgctagcagcagtgggaactgctgtagtgtaaattggttttaggggccaaattgatcaaccaaaagaggcttagagatttttggtgtttgagttactgacgagggttccaactttctggatcacgtgatgaaatgcatggcagttgactctgctatcctctaggttttgtgtctcccttccaacccccatcagcaaccgtttcttgttcttgaggctgcttagcctaagaacttttggtctttgctgtctgggagttacaaatccacaatggcagtgaaagcttttctttctccctcatcctttgtcctttcctacttttggcctttttttgcttttgcaccagttacacttgtgtccatctgctagacacccacagcatcagggtgcttgggcgtggttcctgctgggcagttgaggagctctgggtccacgacccagctctccaagccgcctcaccttgctttccccttctgaaataccactcacctacctgcccacagagggagacagtgagactaacgagaagggcatagggagtaatgagaagaaatgcacagcgtgttctggactcctcgaagagaagtgtttgttcaaggcattattaatatttttgcaaggcacagtaacattgattttttcatccaagaaccatttcgcatttgcacagagtagtcactagagtgttgaaccattttcttttatacatggaggaagtggctcatcctcggcctaagagcaccaaatttgagttggcattttttatttccagttccaggcatgaatctttgctccattttgcaggtagctggaaaatcttctgtttgtttaaatccacgttgggtaatactgcatcattttaagttttctatctggagcccggtacaggaattcaccaatgccaagcacggactctgtgcatagatgccttgtataggctccaagctgcaagcctcccacactgatggatttaaatttttattttacatcccagccaatcaggtgtctgactataacttgaagccaattagtatttttcacagagccaggtgcaaagctgccaggtaacatctgcaagtgacttgcattgctctaatgggatctgcatatgttcagctctgtatgaagatgtttttcacttgacatgaagtcatctttggtcttgttctccctcgactccattaagcagacacacctacgtgtgtggccaatttgatccactttcaaaggaggatggtgcctagtgtttcttttcatgatctattatttatgctgatgcctcttggaaaactgtatctacccatccaaagtgctttgagaggggaggggaaggggtgtggcaacacatctctcagttactatcaaggcattttctgataatacgtggcccaacctaaattatccaataaagatttacttgaggactttgtaaatttcttttaaaaaatatatctgatggaggcaatttttttctcaaagaacatacctgagttcctttaactttgaggaacaaagacgtgggttctagtctcctagtttgcagctgatgagctatgtggctctaggcaggacagcctttgctgagccacttgcataggtgctcactgatggccataggacctgtagaaggagcacacctttccgagtcacactgacctcagtttgaatccctgaccctctctgttggcacagtcatcttgtggaagttttgtgacctctcttttggtttcctgacccatgaaatgggtataataatacatacctcagagggttatttggagagtttaatgctttcatatagacatgcctgcttagtgcctgtacatgatagcttttcaaaaactgctcatcttcacagcctgtcttttttactccactgcttttattttatttcaagtactatacaaatattccaagtggatttttaaaagaatggataactaccagtatttccaacatcctaacctcaactatattctttttttctggggtctcttctagtacatattcacataaagccttaggaattgatcttataggaaatgcctgtaggcaaatatgctcatctctagactggaaattgaaccaaagtattttacaacgacactgtggctaaataagaaaacgtgtttaacagctgaaaacgtcatccaagagcatttagaggaaaaaagaaacagtcctttggccaggattatggcaaagcaaggtatgataatattaacggctgttaattactaagtgcctgatatttgtgccaaacattctttatattatttctttcatccttatagcacccacttagctatgcatctcttttcaaataatgttttcaaatgcataacaaaaaaaaatttcacaggaaaccaattagtttaaaacaacattttttataaaattgaaaaacatttgtgatatagtaacgtatgtgcctcattattaatgcattaaatttcaagatttatttcacaaagaaggggttcaagagcataagtacttttcatagaaccacatggtcaggaaggcttctgctcccaggtcttctacctgcatagtctgtcctcttacccccttatcctgctgcctgaagacacttagggagcttaagactcttagcctaagttcctgaaaacttctctcctggcttaaagtgaatgctgggtaatttatttagtctgctcggggtagtcattcattccaacatgattgtagtccaaggacctcccttcctttcagaacatttgtcacttgtcatgttgcatttaggacgccagaggaggcatccagtgaaatgaacaggaggcacttttgtgacaaatagacttcggaagccaaagctggaactggaaaagaccttgcagatcttcaatcctccttaaggtgcagcctgatggatttccagatccgtgacattttttaaacacttgatcacagcaaaaagaataaacactgatttaaaaggaagacgccgggcctaggtgtaagagagaatgttgccatttttatgtcatcttcacagggaaatagcagatttcatgaactcagactttggagaaaggctaatgtggatttaaattccaggtcatatacttacttgtgtggctttggacaatttactgtaaaatggaggtatatcacctacttcacaggattactgtgagaatgaaataaaagtgatgcgtgtaacacattgacacttggctggcgctccgtaaatgtgtgcacaatacaattcctttcactaaaccagtgatcctctgctttgcctgtttcttagaatcccctgtgtaccttttacaagttctaatgcccagacagcaccccggaccatcagactttttggggtgggagccacgcaacagtatttctccatatccagccaacgttgagcatccctggactagatgcaggctgagtgaggcccaggcacagagggcagcctgtctgcaagggctctgcaggaacacagctcaggacggcagcaggggtcagggcctggggcagtgtggacctctcagctcactccaagagctgcaggcaggaccatccccagggcgtaactgagggcaaatcactctgagggcttttcttctgccacagcacttttatacaagcgaaacagaaaaaaagggcagcctggagaaagattatgatcaaagcaggcagcttaaagagtgatggtaaggaaaggggaaaggagacagccaaacggggtggtgagaaccagcctgcacccgcacatctgactgtgaaggctctctgactttcagtgcaactgtccaaagtgatcgtctctttcacccgctcagaagtcaaggactgggagactcattattttgaatagagtttccccgaatcattattgggaagttcaagtgtggtcccaggatcagcagtgcagcatcatcggagagctggtcagaaatgcagaatctcagaccctgccacagacctgctgagtcagaatctcgagtggtggagcctaggaatacgcattttaacaaattcacaagtgagcatgattgagaagcactgctgtgtatagtgaaaatagagcaaactttaggggcaaacagcacttttgagtttgagccctggctctttcacttactgtgtgatctttgaaaggttgcttaactcctctgaactcgtgtttcctcatttgtaaattggggatacaaagatttaccttaataatggagtccaaggaaattgtgaatgaaatagaggggggtctttggacttggattggaaaaaaaatcatttttgtttttcacaaatttctaactaaaatttagcattttcttttattatgaatgtcagcaacatttgttagcagcctgtgactttgtcaccagaacaagccacacatatttctttttctatttctttcttttttttttttgagacagagtctcgctctgtcgcccaggctggagtgcagcggcacaatttcggctcactgcaagctctgcctcccgggttcacgccattctcctgcctcagcctcccgagtagctgggactacaggtgcccgccaccacgcctggctaattttttgtatttttagtagagacggggtttcactgtgttagccaggatggtctcgatctcctgaccttgtgattcgcccacctcagcctcccaaagtgctgggattacaggcgtgagccactgcgcccctatattacattacagttgttacagataactccaaatatcatttgtattcatccagttcaaaattacagttgcttttaaacttgccgctagatatttaatgcattagtaatgaggcacatacaccatgatatcacaaatgttttttaattttataaaaactgcattttgaattaattggtttcctttataattttttttatacgcagttgaaaacattatttgacgagaggtccatagactcatggcacaaaacactttcaaaagccctccctgcctggaaagttgttgtgatgatttagtgatggaatcaaatgtgtccagcactttttagtgattcaaataacagtgccctgattgtcctccccaacattgtcacgtcttgctttgtgctaagcctgggccaaagattctctagactttcctgggggtgtgtgagaatacacactgtctggtcaactttccctgcaggcatttctctggctaatcctggttttatggaatgagagctgttgtgtgttgagtgcctgctctttgccagattggtgaagtatgctgccttgaatcacatggccagttaagtgggaaagcaggtgggtggtctccatgctgccatgtatattcctgggtggagctaagtccagatgttggcggacagactaaggactcctgcatcctcctagttcaagaagatgacagaagggctatcagtgaaatcactaagcacctacaatctcttagttcttgtacattcaataagcattaattaagcacttactatgtgcctggccctatgctagtcactgggatacgcagctggataggccgtgagccttggctctaagaagactctatgggccctgggagcagagaagggtatcccctaaaccagtggggcagaggtggggactgaaacaaggttcccctgagcaggtggttaatttgtcaaattggctgggcactgtaatgccccggtgtttggtcaaacattattctggatgtttctgtggggtgtttttggatgagattaacattctaatgggaggactttaagtaaagcagattgcccgccataatgtgggtgggccttatccagtcagtcaaagactttcataggacaaatactgacctcctccaagcaagaaggaattctgccagcagacagccttccgacttcagctgcagcgtgacttcttccctgggtctccagcctggtgacccacctggcagattttcaactttccagcctctataacctcctgagcaaatctcttaaaatggatctccccttctatctgcacctcccattgattctgtttctctggagtgccctaatacaaagtccaactggctatattcatttgtgattatgctcctatgtgctttactttttatttgattatgtctcattacacagttcctgtcctggggttctgggcccctgagggattttcattttattacatagaccccttgtgacaatggtgtatctgggctaatgtaaccagtgctgtttcactgggcacaaactatttggggtgcactgggaagcatacatgtaggagggaaaaggaaagacatttattagtgcccactgagtgccaggccctgtgcattttacactaatttcaacctctaatactcggtatacaacaaggtacacagaattattcccattgcacagacaaagaaactgaggtctggaaagggtaagtgacttgtctgagcacaccctgctaataagaagaatcaaagatggcacccaaatctcaggatctgcctgacacccaagacacccgaggccaggctctttaaaacataaaatgctgtttcacacaaaaggtgccaggccaagggaagaggagccccttctcaggacagttgtggttccatagtccattaaaccttcccaccaccaaggggccctgcagccaccccaccccctcccatgagagatcctctgcaccttgcttgaagctcatcaggaaggtcaccaaattgtaaaacaaaggaatccttcagtctcaggaggatctttgaaacaccgcacctcaatccttggccccagagcctaggatccacccagggctccagggcctcaggcatttggcccatcaagtgctgcttgactcctctgtatctcaccccattgtgaccctggcattttgctcagctgatgaggatatcatgtcgggcagcattgcagctcttgtgcagcccgggagattgcatctattgttgtttccttatctgtgtgctctttcattctatcagacaaggaaattaaattggtctggcaccatttgctctctagaaagctactttggctgctaaatccaccaaagggggtggatttatttgggtgtttctttcctaagtgagtgaacaggccttttcagagccgcccacaattaactgaaaggcccgagctgctgtgccaggcccacctgttgtggggatggaagccaaatggggcagatgggatcgaagcggggccagaaaaatagcctcttaatttagcaccagagtcctctcccactctgctccagcccccctacaactggaaaaatgtggaaggcacaaatatgagtcagagaaaaccatccaggaacctgggtgttaaaaccccacctccagactgcagcagggaacgttaggaaaaaagggctgaaaaccgaacatcaatattggttttgctcctgatgcctggaagggtctcccttgccttgtcctcttcatgaatgagcattcacctcttcatcctccaaagggggccctcgcagttttccgcagcctccgcgtccccatgtccccaggcagagagcccactggcccttttgcatctccggcatgttgaaatgacctgttggcatacttacgggctgatattattatggttttttttttttttttttgatttgccccaaaaaggagttgaggtggattacaaacttataactgaactttaaaataaatcactcacttgaaagttggtggcaactttcaagatcagggcaaaaggaaataagaaaaatttatgtaaaatatttactctggggtcttcttggtgggccatggctttggccctcagctttccagcagccaacccgaagctggtgcgtatcagttccttgattcacgctgttcacagctggtcaggtaaggcacggcttttccagttctgaggcctaagaggaactttgctcatagtttctcataaaaaggaccctgtgaggggtcatgaacagtgtccttaacatgtcatggacattgtccttaggtagacatatgtttcatgggactgtgtatcatataacatcctttctgtccgcctatggcaccacatcaccatgcccttcggggaaggcagttctacagggtggccaatacaatgggacttggctgtagtttcctgttagcctgcctagattcacaataggctttccggaatctagaggattcaggatgtagttctcgcttgcctcagtggagacttgaatgagtttatgcagtagtcatgaatgaatattcattcttaccatcgctgctgagcatctgagcccgctccttggctttgtggaattccctgagctaaggcagatcttgcctcccattttagagactgaaagtggcagctacttgcttttctagcctcctttgcagctaacaggtggccagatggcccagtcaccaccaaacagacacatcgccccaagttataaccatgacaagggtgctggtagtggctgcagaaggataatctttttagggcagcacgtgcagcacactgagtgggggcatccagtgactggagctagcagtatcagcaatggagactgtgacctcctcacttgacccaagctactgtccaggccgtaggagcctgaacttattccttctgccctcctgctgaatgtgtgatcttctcgatgtccttgtaatgagtgtatattctgcttaaatcagcctgagttggcttggttgcaagaaaaaacctgcttgatgcaagcagctgttcttctccgctccccgcccacccacatgcaaggcataggaaagtcaaactgctgtgaaagccaaggatgcgtacacgcataaggacacaagccaggtctgctcgcagagttcctgtgatagatagacggacagaaaacttgagggccctgcctgcagcacaggcctgggggcagaaagactgtcccagagcttgctagcctggaatccacagtctagatttatactgtccaatatggtagtcagtagtcacatgttactgtttacatatgaatttaaattagttaaaatttagtacgaccactatggagaatgctttggaggttcctcaaaaaaataaaaattaggctaccataggatccagcaatcccactgctgggtatatacccacaagaaaggagatcagtatatagaagagatatctgcactcctatgtttgttgcagcagtgtttacaatggctaagatttgggagcaacttaagcatccatcaacagatgaatggaaaaagaaaatatggtacataggccaggcatggtggctcacgcctgtaatcccagcactttgggaggccaaggcaggtggatcacctgaggtaaggagttcaagaccagcctggacaacatggtgaaactccatctctactaaaaatacaaaaattagctgggcatggtggtggttgcctgtaatcccagctactcgggaggctgaggcatgagaatcgcttgagcccaggaagcggagtttgcagtgagctgagatcacgccactgcactccagcctggggaatagagcaagattttgtctccagaaaaaaagaaagaaagaaagaaaatatggtacttatattaatacataatggagtactaatcagccataaaaaagaatgagatcctgtcatttgcaacaacacagatggaactggagaacattacgttaagtgaaataagataggcacagaaagacaaacatctcatgttctcacttatttgtaggatttaaaaatcgaaacaattgaactcatggacatagacatagagactagaaggacagttaccagaggctgggaagggaagtcgggggctggatagggggaggtgggtattaaaaaatagaaagaatgaataataactattattttatagcacaacagggtgactatagtcaataataacttaattgtacattttaagataactccaggagcgtaattggattgtttgtaactcaaaggataaatgcttgaggggatggataccccattctccatgatgtgcttatttcacattgcatgcctgtatccaaacatctcatgtaccccataaatatgtacacctactatgtacccacaaaaattaaaatataatgaaacaataaaaacattaaattaaattagttaaaattaaatagaattaaagatctgtttccacaggcacatcaaccacttacggagtgctcagcagccacatgcacctacagactaccattatgtacaagacacatagagaacatgtccagcatcgcacaaggttccattgcacggtgatggcctagaaccttgacattccaggctgagtggcaggatttctgcctttttgagtcacacctattgcttctggtggctgacgaggctgggagttcccaagcaatgaggcagcagttccgccctcctccatcctggtggtctgaaatccacaccagctaccaggaccacagagcactgggccaaggctctgggaaccctcttttccctgctgcatcttcgtctatgtcccttttgctacttcttgttggctgcttcagggggagacaaaagtaaagacaaccttgggtcaagttctcaccatcattctcattatcctggaacctggaccaggctctgcagcctgggctggtgcagaggccatctcaggtatgcaaatgagtgtgttatgcaaatgagtgcttcctacaaataaatgctttatgcaaatgagtttttgcattctctatctctcacactgggctgagcagggactttgtacttaccccaggacctggcacagggcttgacacatcaaagtactcaggaaacattcactgggtacacgtggatgtaacacagatcccgagggacctgacgcacgacaataatttccatgcagagtgtcttcctttcagtccaaggcaaggggggtgacacagtaataatgatgataatgagagtgatgatatgtatatgaaaaaatgaaagtatagagtatgagtttattataaaagtgtaaagaaattggttacatgtgtaaggaaatgtggagttatgggcatatttttcttttcaaattccttcaacattgttattacccatatcagagtagttaagaatatgctcagacagacatggtccccctttgtgaaatgggagctgttacctcatttggctatgtaaggactaaatgagataatgcatgaaaaaattcagcactgcctttggcatataataagtgctaagtacaagggagcaattattgttatttttgcctagaaattcgtgtgataacaatagagcggagcgggactcttggcgtccctgtcattttgtggctgttgcttccctccccactggagtggatggaaagctctgggcctgggtgtgatttctgtcctgacagcccagccctctgcccacagggcaactgggccaagtccccactgcgtgctcccagcaagagggcactgccaaacttctcatacctttttatgcttctcggtctaagccatgggggtttggagggatttttttttttttttaatttgagatctgtcatccttgcaaatgagtttgccctttgcagcaaatccacacaaaacagggacaatctccagttttctttctgttgccttttctcctcccttctgttcgagtcctgcagctactaatgagggcctctgtcagctccctgggagggcaggaagagctgccttcgccctcctccctctccctctgtctctctctctcgcaaacacacacacacagactcaggagagctgcccttctcatctggtcctccttttcctcctttcccccagcttctgccctttatcttgctgttttcacacttccttcctccatctctcctgtgactctttttctctgaatctcatcttctcttctatttcctctcgcataataagtgtgatataagtatttgctatgattatgatgtctcccccatctctttctctctttccctctctctcttcctgtgtctatctttgtaatctttctgtctctcttggtaactggctatttctgtctctcactggctctgtctatctccctctctgtatgtatttctctgtcgtcatctttctgtgtgcatctatttctgtccctctcctctgcctcgtctgtggctctctggctggctcttcatgtcccttaaatcttctaagcccctctgagggctgtggtctgagcacaggaagtaataaggaggagtatgccccaccctgaccccagccaccccaaatcctcaccacagtgcctgagaagtggatccgctccctcttggcccaagataaaaatgcatctctcttcttacagcctcttcctacagagaaaatactgttcatggggtcctgcctggaaaaacttctggttgaggaagtcattttgcgatgcttgcaaaacaaactttcagaaaccaaatttcttgaaacaaaatctttgtggctgtttaactgatttagtctactggtaggcacacagaataactaagactaacacgtttatagttaaagcattgcactttatcttcaccctttcataatctactttttgctacttcagcccactcttcttgtttctcagcataacctttttgtagtaggagaggtgccattattattatctccatttttaaaagtgggaaccgatactcataaagatgcgatgatttgctccctgtcacggagttattttcagtgccgcagggcgcagaacgcttattccctagggaccatgagcccctctcgcgcccctccatgcccctgtcagctctagggctctgtgatttccaccagaaatcccaaacatctcccaccaaacctgcccaagggagactctttgtggctttttcgcacatcgtgtcctttgtaagtcatcgttcccgctgcacacgcgcccaccatctccaggctgaacggctcagagatttaatcacgttctcggactcaggccatggcagtgaatcttggagccacgcggccggagctgcagcagaaaccctggcaacggaaggagctctctgagggtttggtggaataaattactcaaacacttgcatttctacaaaagtagtgacacttaattcctgctatgatattaggataaacaaaatgtcatctgccgcattgtccttgcccatccaaatcttatcttctttttccgtgtaagtaattgggggaaaaaaattacagaaaccttctggagtattatcgtattaggatccgattttaaccagaatgctgaaaatttcatactgaaggcaagtgcatagttgccgtaaatgcaggcgaacttcaaggtgaaggaactcccctgtacaatcgcgaatgcaaatgtttaaagccactcaacaattttccccttgcagctgcccgttttatctcttgcaaaactagtaatgatacaagcagttgattatggtttacaatagcaataaacctctcagaattggttgtttccaaaataaatagccattctgttaaatgttaaataacaagtcataaactgctgaaaacaaccaatttcttgtggattattgcctgaataaatttcagcaggaacggcagatcattaagctgtgagcgtcacagatcaaaaccgttggattaaaaaaaaatcaatcaattaacttaaatccatccaaaggaattcccattttacaaaccaagtcacaccacacatttttacatcttcttttgagcttttcctttgctggtcatggttagcttgattctggccaaaatcttttcattctttttcagagattaaagcatacctaacctgggtggttaaattggctcattctgagagcatgcagctttcctcagctgcattttctacaagtctccatctacagtgttccaattgataaaacacagacctgtccactaagttaaacatttgagtcaaggctcagtggcaaatatatattcaaactgcagctctaatagaggctgttctggtaagagaagccaacttcatcgggatgattgacagaagattcctcgccatagcaaccagggttatctctctggaataacaacattaacctccttcataaccagtttttcatccctgaatataaaaggcagctgcatgcatcttgtatgatcctttttttttatttttgaatgaacagttagcacttctatataaatgggacaagatgcagcaaaatcaaattaattttgaattcctcttgaaaaaaagcatggcaatggatcttgtaggcagaacagttagagcaggaagggttcctgtctcttctgagcatagggcagtagcagtgagatttctagtcatctactgcctctgaaatagcctcctgcattgatttgctttctgctgctgtggagggtgggaaggggcaaataatttgtttcttgttttgttcctgtcttattctttgtcctcacaactcccaacgcatgcacacacacacacacacacacacacacacacacacatccacacacatcttagaggctctcaggtgcaaggcaatgaatggtctatgggaaaatggtgggaaaatgcatattctttctgaaaaaaaatgtatattccatcgctttttttgaaagaaattgctaaatggaccccaaaccatctcctctgacttatatctaatgttttgtgaaagccgtggacattggtgccttgaaatgtcactgaagcctctcaccagcccctcacagaggtgctgtgccatgctctggacctgacttctcatgccagtctctgcaagtagcaagcatggcactcaagccacagggaataaaaactgtgacaaggaaagacagactgtccacctggttggaccactgccaagtcatgtccttccctgtgtcattccatctaggatatttttcccattggcaccaacttcattgcaattgccaccttgaaaagtggagccctcttggttgaggcttctgtgtcactcaaggtcacaatcttgttgctcaaggccctggttgtaacctcaaagaacgtcagtcctctgctgaggaaagaggctgagcagggaaaaggtgccacctgggcccaagcaaggggaacctgggaacatggcatttacaaagtgcaggacagcgtggggcctcagaggggaaagtggtcattcagcagaaacactcgggtgaatctctggcctgatctctatgtaagcagacaaactagccaaaaggcatgactggtggatttcaaaagatgttctgtgaagaaatgttatttctgagttggaagtaggaggaactctttgagatccccactgtattacacaaatgttgacagcctcctcagattccttcaaagccaccttacttccaaagctgctgcctgcccctcacacccctcaccccaccaacagcatcactgtctttgccaagccctggaactgcctggaatccagttggggccctgagtctgtgtgaccctgttaccagaaaggggtctcaattcagaccccaagagagggttcttggatcttgcacaagaaagaatttggggtgagttcatggagtaaagtgaaagcaagtttattagagaagtaaagaaacaaaagaatggctactccataggcagagcagtggcatgggctgcttgactgagtacacttatgtttatttcttgatgatatgctgaacaaggggtgggttattcacgaattttccaggaaaggggtgggcaattcctggaactgagggttcctccactttttagaccatatagggtaacttcccagtgttgccatggcacttgtaaactgtcatggcgctgatgggagtgtcttttagcacacaaatatcacaattaatatataatgagcagtgaggatgaccagaggtcacttccatcactatcttgggtttggtgggttttggctggcttctttactgcgtcctgttttaccagcaggggctttttgacttgtatcctttcatactagtcctgccaacctcctatctcatcctgtgactaagaatgcctgatctcctgggaatgcagcccagcaggtctcatcctcattttacccaactcctattcaagatggagtcactctggtttgaatacttctgataaccccatccccactgctgagcatcctcattcctggtcacttttccactccaggatttggataaaataccacagccatgggcatgggacctggcctcctgagcagctcctgaggagccagatgatacccagaaatgcaaggtgttacctccatggtgtgtgaacctgaaccaaggtaactggaggtggagagtatgtcctccctccaccctgaggtgtgattcaacctggctaatcttctgcagaagtcccatgagctgagcggacacactcagggcagtttgtgtctctagccactcaccaagaagcagcatctagagcagcaccattgcatcaccttgatcctcatctttcctgcctttcctcctctttctttcctcacctctccaaggttacacctctccaataaagcagccgcactgtaatccttgcctcagcctctgtgtggaggacggggctaggaaaactagctacatgagtcatactcagagctcctccctgtggcaagcattttaggtaaaggagtaggtggtgaaaatcatggcctttctctacgaatcagtccaaagactctccccttcatttgctaaatgacccctgatgttacagccacctctggaagctgcaagtttcccaaaagctgaggttgaggaagggtcggttggttaattgtttttaagaagcagtgtaatggaccttattacttaattgacaaagggcttgactggtggaaaatgaagcctccttgcctccaagatgttgcaattagttttctttaaaacagaaaagaaatgttcctgaataatcaaaagaacaatagcaatagtagcaacaccccaagttacaaattgcctgggctattggcctcctttaaacacacacatagggggcattgctttttcctgtccagaggaaagaaagctgatgctcttcccctctcactcaatgccctcctcacaaagtcttgctgaccctgcctcgtgtaaatatttcattatttacgggtgtgttggtttattcacgcacctgcccagccatcctgtgatctctctgtttgtgtggagcctgtgtgtgactagttggttgcagctggtgctaatgaggccaaagcctgggttcaatccccaagggggccagttaacttcacctgctccgtggctagaggctgcactcaacagctctgaatggagcttgtgttgtgtgtactgggcgacaggcacaggggtagagggaagggaggagatggttcagcatgtggtccccatgtctgctggagaaacagccacagcccttggcaccttccacccctgcaaaggtcagcactgtgtttcttgttttttttccccctaagattacttcttttatcctaaggttagaggacgtgggcatgtatgttttaaaatttcccctttttatttaattggcaagtattatgtcttatgagttaaagagtaaggcacatttttttggcctcaattcctttgggcatccattattcatttactagaacacacagcctactggagaggtgcatctgtggacatcagaaaaaaaaaaactaggaggagttacagattgtggcataaggtttggtgaaaatattcaagaaaaaaattattcactcaacaaatacttattgactgcctattatgtctcaggcactacactaaagatacaatagtgaacaaaatagattttaaaatttctgctctatggagcttaaattccagagggagaaggtggtgcaatagatagtaaataagaaaaaggtagtaaaaaatatgtattttacataaccataattttgaagaagaatagagcaggaaatggacagaagtcactaggaagggtactccaactataataggatggttaaggtagacctcagtgaaaaatgatgttagggcaaggacctgaagtaagggagagtgagctgcgtagctagcagagggaagagcaaaggtgagaagggcaaggagggagcatgcatagtgcctggtatgtttgaggaacagccgggcgggggtgcagtgtggctgaggcagagggagtgagggagaggcgatgttcctgaactgaactggggtgtgctcacctgctgcaataagatcaaacatccacacagaggtttgcagagggagaaaggagggcatttatttgcagggcaccaggcaatgttgattgggcagctcatgcttaagacctgaacccttgcaaaggtttgcaagcgagggtttttaaaggcaagggaaattttcaggaaaacaagttaatacaggcaaatttaaatcaaggcatggaggttatacattggtttggcctaagaaggtgggacaccttgaagcggggcctttacacgtcataggtgggttcacagattttctgatttgcaattggttaaggaaaagaagctttgtttaaaaatgtggggttagcagaaaagaacgttagctctggctcacaggtgtgacttcttccaggcccatcaggaagaaagaacgaagagcagtggtcggagttcagtccccggttcccccttatccaaggtctgtgtgccagcagatacatttggtgggggtccaggttttgaaaacaactcagggacatacgttaagaattaatctttagtttctatagggaaccaaacatcccatgactctaatttccttggctattgttttaggctactattaccttcttgctgatcaaattgctcatttacttctcagggccagctaagtgcctgcaatctgaaggaacttaagatttttcatttccatgcttgtggtagtgaggggggcacaggcccctaagaggggtccctgctccatctcaggatgggagatgcagccaagaaaaaagggaggaaggagaatcaggtggcgtctacaggcccttgcaaaagctttggcttctttctcaaaaagttagaaaaggcttcctcaaagatgttgcttctgagtcgggtcccaggagctgattagtgttaactcattcatctgcactccggctgaagcaggtgttgccagactgaccgtgtaatttggtagttaacatgtgtgtaccaggctgtgttttcagacttgaagacagagtggagttagcatctgctcctacccctccctcacccaccccatccccacgcactcatacacactaccggcctgggagtcatatgaagcttatatggtcccaccatgggggcccacacaaggaccgggattagtttgcccaccagccaggcaggtgggggctcagaacagataaagatttgtattatttcttgagccacagttatagatgtcagctcatgcttgctaaagaaacaaatgaaaattaactggcaaggcaaccccagggcaactgaatgagggagaaagcaaacactccccgggttccaagcaggaaggagccacatgggggctactttgggggcatggagg

SEQ ID NO: 797 - DNA, 322938 bp, Homo sapiens
gatttagtgatggaatcaaatgtgtccagcactttttagtgattcaaataacagtgccctgattgtcctccccaacattgtcacgtcttgctttgtgctaagcctgggccaaagattctctagactttcctgggggtgtgtgagaatacacactgtctggtcaactttccctgcaggcatttctctggctaatcctggttttatggaatgagagctgttgtgtgttgagtgcctgctctttgccagattggtgaagtatgctgccttgaatcacatggccagttaagtgggaaagcaggtgggtggtctccatgctgccatgtatattcctgggtggagctaagtccagatgttggcggacagactaaggactcctgcatcctcctagttcaagaagatgacagaagggctatcagtgaaatcactaagcacctacaatctcttagttcttgtacattcaataagcattaattaagcacttactatgtgcctggccctatgctagtcactgggatacgcagctggataggccgtgagccttggctctaagaagactctatgggccctgggagcagagaagggtatcccctaaaccagtggggcagaggtggggactgaaacaaggttcccctgagcaggtggttaatttgtcaaattggctgggcactgtaatgccccggtgtttggtcaaacattattctggatgtttctgtggggtgtttttggatgagattaacattctaatgggaggactttaagtaaagcagattgcccgccataatgtgggtgggccttatccagtcagtcaaagactttcataggacaaatactgacctcctccaagcaagaaggaattctgccagcagacagccttccgacttcagctgcagcgtgacttcttccctgggtctccagcctggtgacccacctggcagattttcaactttccagcctctataacctcctgagcaaatctcttaaaatggatctccccttctatctgcacctcccattgattctgtttctctggagtgccctaatacaaagtccaactggctatattcatttgtgattatgctcctatgtgctttactttttatttgattatgtctcattacacagttcctgtcctggggttctgggcccctgagggattttcattttattacatagaccccttgtgacaatggtgtatctgggctaatgtaaccagtgctgtttcactgggcacaaactatttggggtgcactgggaagcatacatgtaggagggaaaaggaaagacatttattagtgcccactgagtgccaggccctgtgcattttacactaatttcaacctctaatactcggtatacaacaaggtacacagaattattcccattgcacagacaaagaaactgaggtctggaaagggtaagtgacttgtctgagcacaccctgctaataagaagaatcaaagatggcacccaaatctcaggatctgcctgacacccaagacacccgaggccaggctctttaaaacataaaatgctgtttcacacaaaaggtgccaggccaagggaagaggagccccttctcaggacagttgtggttccatagtccattaaaccttcccaccaccaaggggccctgcagccaccccaccccctcccatgagagatcctctgcaccttgcttgaagctcatcaggaaggtcaccaaattgtaaaacaaaggaatccttcagtctcaggaggatctttgaaacaccgcacctcaatccttggccccagagcctaggatccacccagggctccagggcctcaggcatttggcccatcaagtgctgcttgactcctctgtatctcaccccattgtgaccctggcattttgctcagctgatgaggatatcatgtcgggcagcattgcagctcttgtgcagcccgggagattgcatctattgttgtttccttatctgtgtgctctttcattctatcagacaaggaaattaaattggtctggcaccatttgctctctagaaagctactttggctgctaaatccaccaaagggggtggatttatttgggtgtttctttcctaagtgagtgaacaggccttttcagagccgcccacaattaactgaaaggcccgagctgctgtgccaggcccacctgttgtggggatggaagccaaatggggcagatgggatcgaagcggggccagaaaaatagcctcttaatttagcaccagagtcctctcccactctgctccagcccccctacaactggaaaaatgtggaaggcacaaatatgagtcagagaaaaccatccaggaacctgggtgttaaaaccccacctccagactgcagcagggaacgttaggaaaaaagggctgaaaaccgaacatcaatattggttttgctcctgatgcctggaagggtctcccttgccttgtcctcttcatgaatgagcattcacctcttcatcctccaaagggggccctcgcagttttccgcagcctccgcgtccccatgtccccaggcagagagcccactggcccttttgcatctccggcatgttgaaatgacctgttggcatacttacgggctgatattattatggttttttttttttttttttgatttgccccaaaaaggagttgaggtggattacaaacttataactgaactttaaaataaatcactcacttgaaagttggtggcaactttcaagatcagggcaaaaggaaataagaaaaatttatgtaaaatatttactctggggtcttcttggtgggccatggctttggccctcagctttccagcagccaacccgaagctggtgcgtatcagttccttgattcacgctgttcacagctggtcaggtaaggcacggcttttccagttctgaggcctaagaggaactttgctcatagtttctcataaaaaggaccctgtgaggggtcatgaacagtgtccttaacatgtcatggacattgtccttaggtagacatatgtttcatgggactgtgtatcatataacatcctttctgtccgcctatggcaccacatcaccatgcccttcggggaaggcagttctacagggtggccaatacaatgggacttggctgtagtttcctgttagcctgcctagattcacaataggctttccggaatctagaggattcaggatgtagttctcgcttgcctcagtggagacttgaatgagtttatgcagtagtcatgaatgaatattcattcttaccatcgctgctgagcatctgagcccgctccttggctttgtggaattccctgagctaaggcagatcttgcctcccattttagagactgaaagtggcagctacttgcttttctagcctcctttgcagctaacaggtggccagatggcccagtcaccaccaaacagacacatcgccccaagttataaccatgacaagggtgctggtagtggctgcagaaggataatctttttagggcagcacgtgcagcacactgagtgggggcatccagtgactggagctagcagtatcagcaatggagactgtgacctcctcacttgacccaagctactgtccaggccgtaggagcctgaacttattccttctgccctcctgctgaatgtgtgatcttctcgatgtccttgtaatgagtgtatattctgcttaaatcagcctgagttggcttggttgcaagaaaaaacctgcttgatgcaagcagctgttcttctccgctccccgcccacccacatgcaaggcataggaaagtcaaactgctgtgaaagccaaggatgcgtacacgcataaggacacaagccaggtctgctcgcagagttcctgtgatagatagacggacagaaaacttgagggccctgcctgcagcacaggcctgggggcagaaagactgtcccagagcttgctagcctggaatccacagtctagatttatactgtccaatatggtagtcagtagtcacatgttactgtttacatatgaatttaaattagttaaaatttagtacgaccactatggagaatgctttggaggttcctcaaaaaaataaaaattaggctaccataggatccagcaatcccactgctgggtatatacccacaagaaaggagatcagtatatagaagagatatctgcactcctatgtttgttgcagcagtgtttacaatggctaagatttgggagcaacttaagcatccatcaacagatgaatggaaaaagaaaatatggtacataggccaggcatggtggctcacgcctgtaatcccagcactttgggaggccaaggcaggtggatcacctgaggtaaggagttcaagaccagcctggacaacatggtgaaactccatctctactaaaaatacaaaaattagctgggcatggtggtggttgcctgtaatcccagctactcgggaggctgaggcatgagaatcgcttgagcccaggaagcggagtttgcagtgagctgagatcacgccactgcactccagcctggggaatagagcaagattttgtctccagaaaaaaagaaagaaagaaagaaaatatggtacttatattaatacataatggagtactaatcagccataaaaaagaatgagatcctgtcatttgcaacaacacagatggaactggagaacattacgttaagtgaaataagataggcacagaaagacaaacatctcatgttctcacttatttgtaggatttaaaaatcgaaacaattgaactcatggacatagacatagagactagaaggacagttaccagaggctgggaagggaagtcgggggctggatagggggaggtgggtattaaaaaatagaaagaatgaataataactattattttatagcacaacagggtgactatagtcaataataacttaattgtacattttaagataactccaggagcgtaattggattgtttgtaactcaaaggataaatgcttgaggggatggataccccattctccatgatgtgcttatttcacattgcatgcctgtatccaaacatctcatgtaccccataaatatgtacacctactatgtacccacaaaaattaaaatataatgaaacaataaaaacattaaattaaattagttaaaattaaatagaattaaagatctgtttccacaggcacatcaaccacttacggagtgctcagcagccacatgcacctacagactaccattatgtacaagacacatagagaacatgtccagcatcgcacaaggttccattgcacggtgatggcctagaaccttgacattccaggctgagtggcaggatttctgcctttttgagtcacacctattgcttctggtggctgacgaggctgggagttcccaagcaatgaggcagcagttccgccctcctccatcctggtggtctgaaatccacaccagctaccaggaccacagagcactgggccaaggctctgggaaccctcttttccctgctgcatcttcgtctatgtcccttttgctacttcttgttggctgcttcagggggagacaaaagtaaagacaaccttgggtcaagttctcaccatcattctcattatcctggaacctggaccaggctctgcagcctgggctggtgcagaggccatctcaggtatgcaaatgagtgtgttatgcaaatgagtgcttcctacaaataaatgctttatgcaaatgagtttttgcattctctatctctcacactgggctgagcagggactttgtacttaccccaggacctggcacagggcttgacacatcaaagtactcaggaaacattcactgggtacacgtggatgtaacacagatcccgagggacctgacgcacgacaataatttccatgcagagtgtcttcctttcagtccaaggcaaggggggtgacacagtaataatgatgataatgagagtgatgatatgtatatgaaaaaatgaaagtatagagtatgagtttattataaaagtgtaaagaaattggttacatgtgtaaggaaatgtggagttatgggcatatttttcttttcaaattccttcaacattgttattacccatatcagagtagttaagaatatgctcagacagacatggtccccctttgtgaaatgggagctgttacctcatttggctatgtaaggactaaatgagataatgcatgaaaaaattcagcactgcctttggcatataataagtgctaagtacaagggagcaattattgttatttttgcctagaaattcgtgtgataacaatagagcggagcgggactcttggcgtccctgtcattttgtggctgttgcttccctccccactggagtggatggaaagctctgggcctgggtgtgatttctgtcctgacagcccagccctctgcccacagggcaactgggccaagtccccactgcgtgctcccagcaagagggcactgccaaacttctcatacctttttatgcttctcggtctaagccatgggggtttggagggatttttttttttttttaatttgagatctgtcatccttgcaaatgagtttgccctttgcagcaaatccacacaaaacagggacaatctccagttttctttctgttgccttttctcctcccttctgttcgagtcctgcagctactaatgagggcctctgtcagctccctgggagggcaggaagagctgccttcgccctcctccctctccctctgtctctctctctcgcaaacacacacacacagactcaggagagctgcccttctcatctggtcctccttttcctcctttcccccagcttctgccctttatcttgctgttttcacacttccttcctccatctctcctgtgactctttttctctgaatctcatcttctcttctatttcctctcgcataataagtgtgatataagtatttgctatgattatgatgtctcccccatctctttctctctttccctctctctcttcctgtgtctatctttgtaatctttctgtctctcttggtaactggctatttctgtctctcactggctctgtctatctccctctctgtatgtatttctctgtcgtcatctttctgtgtgcatctatttctgtccctctcctctgcctcgtctgtggctctctggctggctcttcatgtcccttaaatcttctaagcccctctgagggctgtggtctgagcacaggaagtaataaggaggagtatgccccaccctgaccccagccaccccaaatcctcaccacagtgcctgagaagtggatccgctccctcttggcccaagataaaaatgcatctctcttcttacagcctcttcctacagagaaaatactgttcatggggtcctgcctggaaaaacttctggttgaggaagtcattttgcgatgcttgcaaaacaaactttcagaaaccaaatttcttgaaacaaaatctttgtggctgtttaactgatttagtctactggtaggcacacagaataactaagactaacacgtttatagttaaagcattgcactttatcttcaccctttcataatctactttttgctacttcagcccactcttcttgtttctcagcataacctttttgtagtaggagaggtgccattattattatctccatttttaaaagtgggaaccgatactcataaagatgcgatgatttgctccctgtcacggagttattttcagtgccgcagggcgcagaacgcttattccctagggaccatgagcccctctcgcgcccctccatgcccctgtcagctctagggctctgtgatttccaccagaaatcccaaacatctcccaccaaacctgcccaagggagactctttgtggctttttcgcacatcgtgtcctttgtaagtcatcgttcccgctgcacacgcgcccaccatctccaggctgaacggctcagagatttaatcacgttctcggactcaggccatggcagtgaatcttggagccacgcggccggagctgcagcagaaaccctggcaacggaaggagctctctgagggtttggtggaataaattactcaaacacttgcatttctacaaaagtagtgacacttaattcctgctatgatattaggataaacaaaatgtcatctgccgcattgtccttgcccatccaaatcttatcttctttttccgtgtaagtaattgggggaaaaaaattacagaaaccttctggagtattatcgtattaggatccgattttaaccagaatgctgaaaatttcatactgaaggcaagtgcatagttgccgtaaatgcaggcgaacttcaaggtgaaggaactcccctgtacaatcgcgaatgcaaatgtttaaagccactcaacaattttccccttgcagctgcccgttttatctcttgcaaaactagtaatgatacaagcagttgattatggtttacaatagcaataaacctctcagaattggttgtttccaaaataaatagccattctgttaaatgttaaataacaagtcataaactgctgaaaacaaccaatttcttgtggattattgcctgaataaatttcagcaggaacggcagatcattaagctgtgagcgtcacagatcaaaaccgttggattaaaaaaaaatcaatcaattaacttaaatccatccaaaggaattcccattttacaaaccaagtcacaccacacatttttacatcttcttttgagcttttcctttgctggtcatggttagcttgattctggccaaaatcttttcattctttttcagagattaaagcatacctaacctgggtggttaaattggctcattctgagagcatgcagctttcctcagctgcattttctacaagtctccatctacagtgttccaattgataaaacacagacctgtccactaagttaaacatttgagtcaaggctcagtggcaaatatatattcaaactgcagctctaatagaggctgttctggtaagagaagccaacttcatcgggatgattgacagaagattcctcgccatagcaaccagggttatctctctggaataacaacattaacctccttcataaccagtttttcatccctgaatataaaaggcagctgcatgcatcttgtatgatcctttttttttatttttgaatgaacagttagcacttctatataaatgggacaagatgcagcaaaatcaaattaattttgaattcctcttgaaaaaaagcatggcaatggatcttgtaggcagaacagttagagcaggaagggttcctgtctcttctgagcatagggcagtagcagtgagatttctagtcatctactgcctctgaaatagcctcctgcattgatttgctttctgctgctgtggagggtgggaaggggcaaataatttgtttcttgttttgttcctgtcttattctttgtcctcacaactcccaacgcatgcacacacacacacacacacacacacacacacacacatccacacacatcttagaggctctcaggtgcaaggcaatgaatggtctatgggaaaatggtgggaaaatgcatattctttctgaaaaaaaatgtatattccatcgctttttttgaaagaaattgctaaatggaccccaaaccatctcctctgacttatatctaatgttttgtgaaagccgtggacattggtgccttgaaatgtcactgaagcctctcaccagcccctcacagaggtgctgtgccatgctctggacctgacttctcatgccagtctctgcaagtagcaagcatggcactcaagccacagggaataaaaactgtgacaaggaaagacagactgtccacctggttggaccactgccaagtcatgtccttccctgtgtcattccatctaggatatttttcccattggcaccaacttcattgcaattgccaccttgaaaagtggagccctcttggttgaggcttctgtgtcactcaaggtcacaatcttgttgctcaaggccctggttgtaacctcaaagaacgtcagtcctctgctgaggaaagaggctgagcagggaaaaggtgccacctgggcccaagcaaggggaacctgggaacatggcatttacaaagtgcaggacagcgtggggcctcagaggggaaagtggtcattcagcagaaacactcgggtgaatctctggcctgatctctatgtaagcagacaaactagccaaaaggcatgactggtggatttcaaaagatgttctgtgaagaaatgttatttctgagttggaagtaggaggaactctttgagatccccactgtattacacaaatgttgacagcctcctcagattccttcaaagccaccttacttccaaagctgctgcctgcccctcacacccctcaccccaccaacagcatcactgtctttgccaagccctggaactgcctggaatccagttggggccctgagtctgtgtgaccctgttaccagaaaggggtctcaattcagaccccaagagagggttcttggatcttgcacaagaaagaatttggggtgagttcatggagtaaagtgaaagcaagtttattagagaagtaaagaaacaaaagaatggctactccataggcagagcagtggcatgggctgcttgactgagtacacttatgtttatttcttgatgatatgctgaacaaggggtgggttattcacgaattttccaggaaaggggtgggcaattcctggaactgagggttcctccactttttagaccatatagggtaacttcccagtgttgccatggcacttgtaaactgtcatggcgctgatgggagtgtcttttagcacacaaatatcacaattaatatataatgagcagtgaggatgaccagaggtcacttccatcactatcttgggtttggtgggttttggctggcttctttactgcgtcctgttttaccagcaggggctttttgacttgtatcctttcatactagtcctgccaacctcctatctcatcctgtgactaagaatgcctgatctcctgggaatgcagcccagcaggtctcatcctcattttacccaactcctattcaagatggagtcactctggtttgaatacttctgataaccccatccccactgctgagcatcctcattcctggtcacttttccactccaggatttggataaaataccacagccatgggcatgggacctggcctcctgagcagctcctgaggagccagatgatacccagaaatgcaaggtgttacctccatggtgtgtgaacctgaaccaaggtaactggaggtggagagtatgtcctccctccaccctgaggtgtgattcaacctggctaatcttctgcagaagtcccatgagctgagcggacacactcagggcagtttgtgtctctagccactcaccaagaagcagcatctagagcagcaccattgcatcaccttgatcctcatctttcctgcctttcctcctctttctttcctcacctctccaaggttacacctctccaataaagcagccgcactgtaatccttgcctcagcctctgtgtggaggacggggctaggaaaactagctacatgagtcatactcagagctcctccctgtggcaagcattttaggtaaaggagtaggtggtgaaaatcatggcctttctctacgaatcagtccaaagactctccccttcatttgctaaatgacccctgatgttacagccacctctggaagctgcaagtttcccaaaagctgaggttgaggaagggtcggttggttaattgtttttaagaagcagtgtaatggaccttattacttaattgacaaagggcttgactggtggaaaatgaagcctccttgcctccaagatgttgcaattagttttctttaaaacagaaaagaaatgttcctgaataatcaaaagaacaatagcaatagtagcaacaccccaagttacaaattgcctgggctattggcctcctttaaacacacacatagggggcattgctttttcctgtccagaggaaagaaagctgatgctcttcccctctcactcaatgccctcctcacaaagtcttgctgaccctgcctcgtgtaaatatttcattatttacgggtgtgttggtttattcacgcacctgcccagccatcctgtgatctctctgtttgtgtggagcctgtgtgtgactagttggttgcagctggtgctaatgaggccaaagcctgggttcaatccccaagggggccagttaacttcacctgctccgtggctagaggctgcactcaacagctctgaatggagcttgtgttgtgtgtactgggcgacaggcacaggggtagagggaagggaggagatggttcagcatgtggtccccatgtctgctggagaaacagccacagcccttggcaccttccacccctgcaaaggtcagcactgtgtttcttgttttttttccccctaagattacttcttttatcctaaggttagaggacgtgggcatgtatgttttaaaatttcccctttttatttaattggcaagtattatgtcttatgagttaaagagtaaggcacatttttttggcctcaattcctttgggcatccattattcatttactagaacacacagcctactggagaggtgcatctgtggacatcagaaaaaaaaaaactaggaggagttacagattgtggcataaggtttggtgaaaatattcaagaaaaaaattattcactcaacaaatacttattgactgcctattatgtctcaggcactacactaaagatacaatagtgaacaaaatagattttaaaatttctgctctatggagcttaaattccagagggagaaggtggtgcaatagatagtaaataagaaaaaggtagtaaaaaatatgtattttacataaccataattttgaagaagaatagagcaggaaatggacagaagtcactaggaagggtactccaactataataggatggttaaggtagacctcagtgaaaaatgatgttagggcaaggacctgaagtaagggagagtgagctgcgtagctagcagagggaagagcaaaggtgagaagggcaaggagggagcatgcatagtgcctggtatgtttgaggaacagccgggcgggggtgcagtgtggctgaggcagagggagtgagggagaggcgatgttcctgaactgaactggggtgtgctcacctgctgcaataagatcaaacatccacacagaggtttgcagagggagaaaggagggcatttatttgcagggcaccaggcaatgttgattgggcagctcatgcttaagacctgaacccttgcaaaggtttgcaagcgagggtttttaaaggcaagggaaattttcaggaaaacaagttaatacaggcaaatttaaatcaaggcatggaggttatacattggtttggcctaagaaggtgggacaccttgaagcggggcctttacacgtcataggtgggttcacagattttctgatttgcaattggttaaggaaaagaagctttgtttaaaaatgtggggttagcagaaaagaacgttagctctggctcacaggtgtgacttcttccaggcccatcaggaagaaagaacgaagagcagtggtcggagttcagtccccggttcccccttatccaaggtctgtgtgccagcagatacatttggtgggggtccaggttttgaaaacaactcagggacatacgttaagaattaatctttagtttctatagggaaccaaacatcccatgactctaatttccttggctattgttttaggctactattaccttcttgctgatcaaattgctcatttacttctcagggccagctaagtgcctgcaatctgaaggaacttaagatttttcatttccatgcttgtggtagtgaggggggcacaggcccctaagaggggtccctgctccatctcaggatgggagatgcagccaagaaaaaagggaggaaggagaatcaggtggcgtctacaggcccttgcaaaagctttggcttctttctcaaaaagttagaaaaggcttcctcaaagatgttgcttctgagtcgggtcccaggagctgattagtgttaactcattcatctgcactccggctgaagcaggtgttgccagactgaccgtgtaatttggtagttaacatgtgtgtaccaggctgtgttttcagacttgaagacagagtggagttagcatctgctcctacccctccctcacccaccccatccccacgcactcatacacactaccggcctgggagtcatatgaagcttatatggtcccaccatgggggcccacacaaggaccgggattagtttgcccaccagccaggcaggtgggggctcagaacagataaagatttgtattatttcttgagccacagttatagatgtcagctcatgcttgctaaagaaacaaatgaaaattaactggcaaggcaaccccagggcaactgaatgagggagaaagcaaacactccccgggttccaagcaggaaggagccacatgggggctactttgggggcatggaggaaaaggtaattatagaacactttgaggagcagataagatttgagtgggtcttgaagcacaggtgagtgtgaatcttcaaatgggagggagagcatgacaagtcattgttcctttgtgaggggcggtaggaatttttggaaatgttcaggagtcaggaagaggaccatctaggctagaatggagtggctgtgtaggaaaagggctggcagagagtgaggcagattgtggaagtcccggaatgccagctggaaaagtttggacttttgctgagggtgattctctgctttggatggcaggactgtagcagacagaaccatgtctgttcccatatgcatataagtatgtgtgtggtagcctcgccagatataaaatgcaagggaaactctgttaagtttggatttcagatcaacaacaaataagttttcagtataagaatgtcctatggggccaggcacggtggttcacgcctgtaatcccagcactttgggaggccaaggcgggtggatcacctgaggtcaggagtttgagaccagcctggtcaacgtggtgaaaccccgtctctactaaaaagacaaaaattagccaggcgtaatggcgggtgcctgtaatcccagctacttgggaggctgaggcaggagaattgcttgaacctaggaggtggaggttgcagtgagcttagattgcgccactgcactccagcctgggtgacaagagcgaaactccgactcaaaaaaaagaaaaaagaatgtcctatgaagccaggcacagtggctcatgcctgtaatcccagcactttgggaggctgaggcgggtggatcgcttgaggttgggagttcgagaccagcctggccaacatggtaaaaccccaactctactaaaaaatacaaagaattagctgggcatggtagcgggagcctatagtcccagctggtagggaggctgaggcaggagaatcgcttgaacccagaaggtggaggttgcagtgagccaagatcgcgccatcgcactccagcctgggcaacaagagtgaaactcagtctcaaaaaaaaaaaaaaaaaaaaagaatgtcctatgaaatatttggcacataaatacaggatgcccaggtaaatttaaatttcacataaactatgtacagtttattttatttattttattttatttttttgagacaaggtctctctctgtcacccaggctggagtgcagtggcacgatctcggctcactgcaacctccacctcctgggttcaagcgattctcttgcctcagcctcctgagcagctgggactacaggtgcatgccaccacacccagctaatttttgcatttttagtagagatggggtttcaccatgttggccaggctggtcttgaactcttgacttcaagtgatccgcccacctcagcctcccaaagtgctgggattacaggcatgagccaccgcacccagccaaacaatgtgcaatttttaagtataattacatcttgcaatatttgggatgtagttatgctaaaaaaaattcatcactcatttgaaattcaaatttaactggacatgctgtatttttatttgctaagtctggccatcagtatgtgatgctgaataaatgctacttaccagtgctgtgaactccagggcagagctccctcctgttacactaactagcctggagagttccgccaccagagagccaatttctcggccgcctttgggtgctgactcagctctctgatgacccaagtttatgagttacctgtgagaatatctgggcccccagttttctcaagagtcagccccagatccccaattctgcctctcaaaatcgaggaataggagccctggctttttccagcagcagctggaatcaataagcagccctgatgtgtggggtgggctggaacacagcctgctaccttgagccctgcagtattgatcgcacaggcagctgtctgtaaaccaagcaggcatgctgaaatggggtagtgttgtcagccttcactttcatagggatgactcttcagatttctctcaaagcctgtcgggctcaaagggaaaaccagcaagttcttttttttcactaatgtaatgccttggggagctgccgcattacattctttttttcttttttcttttttagtgcaaagttgtgggggtggaaggcagaaaccacaacaatcctctctcttttgggactctctctcttaaatgtggtccatcattcagttttaataactgaagcacaaaatatgaaaactaaaaaaagtcattttttatcgaaagcctcaaatgtactgggcatgagagcgagcagtttgtatgtcttgtggtgttttatgcttctaatgattctctgagattgatatttattactattcccattttacagattcagaaatggaggctcacccaggctaagtaatttgctcagggccgtgcgtcccgcagtgagtctgctatggtcgaaacccaggtctgtttgacatctaacactactgtctgctcaatgagcccaagacattgcaaacactgctggcttgtcatcctagcttgtccttttagattcctgagtgatgaacatcctctgagaaactgtccctggttgctctgaaaaaagccgggtacctccctctgctctcagatgactttcttcccacctgtgtgttgtagaacctccctgtggggctgtaaaaacacatccacctttctgtgtcctcattaatccacaaggtcctccagggcagcggcaaaattgtttttctaccaagtgtgctcctctctagctgcagggactagactatcgtttagcacacaagctctataaatatctgctcgtggttattactgttttgaaatctcttttcccatttgtttagggagcttcaaggatgctgtcctgtcaccatgtttcattgtgatgccggtcttctgcgttcttacctatgttttttacaccgaattttgtattggcctgtcctcattgaggactcatctggctggtccataccaatattaacagaaagttcttccatggttgaatgactgaacaagtatggttgccatgatgactatatttgcacaaatccaagttggtcttctcaatggttcttcctataatttggtagaagggtatagaggtaaatgaacccaatgggtagccaaattcctgcacctgggatctcaaggtcaatgtttttttttatcacagtgatatagggtgtctcttggagactcaagagaaagagggttgtcaatgagagagggtaaaagatgacagagtggctttgatcctaccttctcacaaaagcttcttagaaaagtcaacctacttttgagaggagcacaggttctcacaaaaccccttccaggaagtagagaagcaaactttgccatgattctgctaccaggagtaaacatgtgatcccacatgtactctgccccttcagggatgaaagagctatgaagctgatggttgatcctcagggacagacattggctgagaggacttgatggatttcagatctgcccacctgaagcccaaacgctgaggaagtctctaaatggggattatagcatttaaacattttttatctttatgttcttctgcaggtctgaggcccttcagactaacagtgatccccctgtcacattaattcttctcacatagactgtttttcttataggtcctatctggggcaaagatgactatgacagaaatctcagcttgttcttgctgacagagttaaatttggtctgtgtttgctctgcacaagaagaaagcctgaactgtgctgaacaactgtcttgagggcacgtccagagccacgtttgtctctctcatgttcctccttttattgtttttgttcctgtacatatttcagtgatgtcaggattttttttaagcctccaccttaggggaagctcaagaaatggtctgtgttagcactggtgaggccaagacagttttatgcatataagcctggctgtttgttgatcccttggaatgagaaaccaattggaatatcctggctgtgagaaatataacccttgaccagccaaagtcatttgtctgccttccctgttgaaagaagcacatttaaaatttctcacctgggagaaacttcctggaaagaatatttcatgcaaaataatacacttcttggacctgagttgcaatttggattagaaaaaaatgacctcattatgtctgagcatatatttttgttagaagccattctgagaacaagagcatgtggccgggtgcagtggctcatgcctgtaatcccagcactttgggaggccaaggtgggcggaccacttgaggtcaagagtttgagaccagcctggccaacatggtgaaacccgtctctactaaaaatacaaaaattagccagacgtggtgttgcacacctataatcctagctattcagggggctgaggcaggagaatcgctggaacccgggaggcagaggttgcagtgagccgagattgtggcactgcactaaagactggagacagagcgagactccatctccaaaaaaaaaaaaaaaaaaagggggcatgggttattcaagggattgttgagttgtttatacatgatctataccttggagtaggttttggatgcattttgctccacatcccgaatgaggggtttgaaggttgaactgctatgttgatttaatgctgtggttgctagggaggaggccccagaaaagttcagaatgttaaaatcaagtgttaaaatatgctgggaggaaatgcagaacagttctcaatttccatcatgagagctttatagatagttactggaagaaaaaaaacctccaaaaattaaagtcagagatttatattttgtacacattttgaattttggagaatgttacttcttcctccagagatcttgttttgctttttaaattagccaggttttatgaaatacattccctaaggaacgctgaagaaatttccaatcaagattcttagtttctagtgctttgagggcaacaattgtacccaaaaaatttctctctttcttagaatctgccacttccagaggcctgtgcttggaaggcaggtgaccaagtggcatttgggtaccttgctggagaatggatgttagcacctgctctggggtaactagggttgccagtcctgctgggcaattggttatgcatctgttgcagctgtacactttgcgaaagatggatgatggggcatgactgcagaaaccttagaaattaaaaaagatatattttatatatatcatcagggagatcttgagaatttgccattcagagtatgaccgggagaaacaagactattttgaatccacaggttcaaatacagcatagaagatgcaggaagtggtatttggcctgatgtttctctcaatgtcattgacaacaacaaggatatatgctaaaaccagatggcagtgccttcctgatttctactgaggaaagctgtgcttctcgaatgctaatgtgtatatgaatcaccagaggattgtattaaattgcagattttggttcagtaagtttgggtagagcctgagattcttgcttcttgagctcccaggtgatgttgaagctacaggggcaggatccacctcctccctcactcttgccaggagaatacccaacatctttccagtgtctatcagactaggctgagcacttcctctaagatctgctgaaccctggatactcaagtttgcaacacaaaggaaggaaccaaggggtagaaactcccctgggaagagacagtgttctctgtggtagaattggggagggaacccaaatggaagcagggaccccgaaggagggagctggatggagaaaacagggtattagcaagacaaaggacagggagggatgtctccatgggaagctgaagccctttacaacctccaccttccaaagactcaagtctgcaaggctgtccttctgcaacagaattcaatggttaaatgaaatctacttaggacttctatttctcactcatggaaatgctactttgagctatatctgatctttcaataaataactttctcctggcaccactataatctcgttatcatacctatatcagcaggacacagtggggtaccaacagaaaaccccttcattttctcttactgttgtctttcaaccccaatcctccctgaccttggacagtatctaggcccaagtgcatagcttttctgattacttccaggtaatgatgtacacacttatcatcagatattaaaaacttcaaaaacaacctgatctcaaaactgtaatctctcatcctatttcaagcttctcctctctctctagctcagaccagactcctgcagaaacctgcagggaaagaaggtgtgaacaattccatgtcctcccccgctgctctgctgcttcgggttcaggttggactgggagagggcagaggagcagcaaggggagtcaggagcttttcacctgagctgttggaatctgcagttaggaatctgccctctgtgtgacctgagtcctaactcagctgtctgctagttcccaggataattccaacaggagcacttaccaagtaacgacctatatcagcactcttctagatgtcacgggaaatgaacatcctcaaagtaactctcattgcagagtaattcagagttggcaatttgatttttctctttcttggtctcataaattgttctccctctaggaaagctgtataaattcccactaaaagtggcccttgccttgaagactggtttgcaggcatgagacctttccctgggttactggcagccctttaattcacgtatgaagcctctttgtcctgcagtcacgggtccaagaagatggctcaggataggcagccccacattttttttgctcaacatatatagatgactggaagtggaactattcaaactactaaaactttcagacccctctccagaatttctaggataatgtctacaaagtacattctaggtttagcataagctactatggggaaaagaaagaagagaaaaagagaaggaagaatactccccagaagtccaacctcagaggctccgtgggtttctggtcggactgccctgatgctcagaggacaaacatcaacttggggccagtgtgaggtgctgaccccttggccagatgagctggattatattcacgcctcgggtcctgctcacagagtgagaatgaacccttaatactttgctggattcacaagagggcatctggttttaaagattcttttgctgtgggttgaattgtgtctcccctatgctccccaaaaagataggaagtcctaacctccatactagagatgtgatcttatttggaaatagggtgattgcagatgtaatcggtttaggtcagactggagtagggcaggccccgaatccagtaagactgatgtccttagaagaaggcagccctgggcagacagagacacaccaggagagctccaagtgatgatgaggccagaaccaaagaaagccacaggatgctgaaggcagagatgtaggaagggacaaagaagtatcctcccttagggctttcagagggagcgtggccctgccaacaccttgatttccaacttttggcctccagaactgagacatacatttctgttgttttaagcaacccagtttgtggtactttgttatggcaacccagggaaactaatacacctcatatggcccttacaggaggatggtaactgcatttgcttgcgagcatatctgatctcacgcaatagcgtggaagctcctaaggttccctggagcccattgcctaacacagaacaaatacagtgtgtgccagtaaattttggttgaatgaacaaatgtaggactttcaatcttaatggtagattaaatacaaacaaaatataagaattaacaagggagaaaggcatacctagattggtgtgtatatttcattcacaacaacattatataatcttgtttatgatttgcataaatgagctattatgccataatttgaaactcaaatcggtggcgtctccctgcaacatgaatgagatgaaacaagtcttcctctcctctctgcatgttaaagatgattgctgtgttagtccaatgatagatcccggtcttcactgtctcataacgtctcagcatcttttctggtttctcactggggctggaatagctgctgagggactcttcctgcctgtgagatttacattatttgagatttaaagcaaacgctatttcaaaactagcagtaacttcaataattggtggaagtgattgccccaaggtggaatctccggtcatcaatttaacttacctagttcttaatctccagaaaatagctggcctctgaatcattgctgtatacttaagaggccacgatagaagagtcccagggccttggaaaagatttgtggtgataatctcattgggactttatttcttcatggattcctttctgaatagcaacttagcacatacacaattgagagggataactgcatgtatgtgtgtgcatgtgtgttcatgcatggagtacaaccagcagaagagaaggactagaggacccatattgcaatcacttatgggaggatgcataagaaaatacaagggagataagaaaaagaaaacctaataaattagaattaattattaattgcaaattagtaaccaattcctttaataattttgtctctcttttcacaattctttatcttttgtatttaaagattctggttccatttggtgatattcatttgcttcttattcaaatgagatgaccagggatagtttgggggaattttttttggaccctgacaggggtcatgtctttcaatcctatccctaaattcatacccatatcttcttcagtccaaatttaattcagcccaacacatatgggatgatttcctatcttatgccaggctcagtgcttgacagttgaatacgaagatgagtaacacggctccagattatgaggagtttctaatctggcaaggggatgagatgcattacctaggtgtgacagggacctttcattttctgtccttatgggtgatctttgccaatccctggagggcaatcaagaggttaagacatattgcctcccaaatctggagtcttctctagcttctcccgggttgtgagtctcttctatgcagctgatcctacaggtgatctcaaaagcatcccacccaaagggttgtacaggcccatttctccttgggccaacctacattttagaccttgccaaattcaatacttgagactacaatttagacacatggaattctctaccgaatggctattggtttggagtttccatttgggttctaaccaattgagcaatggtgcaagcgttccccagggggaacaaaaagtgggatctattttattgtagatgcagcgagtgcccagtgacctcgagaacatggggctcctgggcaacgctggactgcagcattgtggggcccccagaaccaaaatctaccttccgattccttccaccagaatggaagttatgtggctcccagtgaatatcaggctgacctcattgagtcataaatgaaggagaaagatgagatagaagagaggggtgagcctgtttgggcttcccaataacaggcctgtctggtatgtgacccagcatggagcctgaatacaaaggacccatcctgcctgagcatagatgggccaagagagcaagacaggggctgaccctgttttctacttttaaagccaagcaccccactcactggcatgtgggatgtgatcccaagagtttctgcctctcttggatcacgaatcaagccagtttttttaagaaggggaaaacagtaaaatggggatccccccttttttttaagaaggggaaaacagtaaaaatggggatcaaaatgtacattcccacacttcctatcttggagtggaaatctcctttcctctatgaaaacctggatgtgctgttgggtaggggaggcagctgagaatgttcctggcaatgaggcaagcaaactactactagacaaaaacttgcaagactatttccaagtatgtagcagggattcgagttgaaattctaggtagacatttccttctcttgtaccttcccattttggccctgcatgaggaggctgtctcctcagatgttccgtgagcacttgtcctgaatttcttccctctgatcatccactctgcagctatctcctcaggtctgtgagtgcaggaacaccacatctgtgtagggaaaatgtcgtgcctctctacgggttgatttaagactcttgtgacctagagcttcagctacatgtgtaatgatgttttctgctgagtcaccgcagctgctgggtgcaggtgggctgagaactcctaaatgggacccagggaaaagctacaggtgggcttgtcaccttacaagtcatctatgaagttgcaccttgccttagagatcacacagcctgaccctataatcctacatggagaaaggggcatgtttccaatttgcctttcttttagctttgcctcttagggacagtggacacctcactgcagggcaaggaagcattggatcctcttctgcccctcccaggcctggctgccttatgaggccatcaggagaaactcgttgtcacagagtgagtgacgatgtcaagtgcggggcagtgccgtggattaaattgtttgtaggtcttctgataaaagcaggcaggaaagagggtctgcaggttgctccaacatagacacataggtaatagagcttattcaggggagggaagagtgagaccccacaggaagtatcaataagattttgaaggttttcaaagagtaaaaagctcaaacctaacaggcagtaagggatgcaagctggaggcagtgctgcgggaggttgggggaagcagatggaagagcaaggacctggggtgaaaaagcaaattcagcctcggtttgtgttcaggcaaagggagggtcagcttttggctgtggtatagaaaatcagtaaggaagtgagaagactggaaaaggcaaaggggctgaaagccaggctgcagagttgatatttcatacgggagtatcctgcagttattggaagagtctgaggagaatgatctgatcaaagcagcactttaggaaggctaatctgtcacagtgtgtaggagggactggaggagaaacaggcaggaaggcagaggtgggagaactgtcagctaggatgaggatgacgatggtgatgaaaagatgatgtaaatcgtgaaaaagatgaagatgaggatagcagctaagattcattgtttattaatgacattcattattctaagtactttgtatctgttatcttatgtaatcctcacaccctcctatgaggtgagactgttttacaaataataaaactgaaaaacagagaagtaacttgtccagggtaactagctaataagtggtggacctagggtacaatccaggtgctctaatttatttatccaggcaaaatgcaatgagctgagcaaaagcagagtggtggtcatgggaaggtggagatggattgggatgtcacagggttggaggccacctgatcagatgtgatggcaggagagaggtaggtggattgggagaaggaaaagtggaaagggccatccagcttattgccataggtcactggggacatagtgggaatatcaattaaaataggggtgcccagaagagggactggtttccaggtgaagatggcacaccagtcagccaccaccatctctgatctgcagtgctgcaattatgtctctttgtcccttacaatcattctttacatggcaactcctacatgatgtaaagcggatcatgttattccccattaacatccttcaacgtctccacagctctcgaatctaaaatccagtctccttactctggcagacagattccacaggagctgccccagcctctttctggcaccgtgtcatagcttgtggctgcatcactctaacccccaaggctagtaccttcaaatctctctatgctccatcatcagattgctttctcctccatgtgtcaatgtcagaatctttctctgggccaaatgcagtggctcacacctgtaattccagcattttgggaggccaaggagggaggacggcttaaacccaggagttcaagaccagcctaggcaacatagtgagattccatctctacaaaaaattttgaaaaaattagctgggagtggtggtgcacacctgtagtcctggctacttgggaggctgaagcaggagcatcacttgagaccagaaggtggaggctgcagtgagccatgttcacaccactgcactccagactgggctagacagtgagacctcatctcttaggagaaaaaaatctctctctgcttctcaatcagaaagatacttatgtttgtacttagggtccactctgagaatccaggataatcttcccatgtcaagacccttatttagtcaaatctgcaaagaccctctttccatgtaaggtgacatgtataggttccggggattaggacctgatattttatgggaaccattacctagcctcctataatttctgctgccctccacttactctgtgcgggaaatcagctgtaccctaggtgcctagaagggtaccaggcacattgtagatgctctactgtgatttattaaactagcaaataaatgaatatagccaagtgtattttattctaaaaagtattttccctatatgttcataatttaataacaatacatcatattgttttaattctaaaacagtcaaacagctttgatacgacagtcatcttatataaatgaaaacgtgatctaatgaaatggcattttatgagctttaggcgaagcaaccatttgaatgatcttgtttaaattaaatggcccttttgtgttcagtagtcagcatcactaagtgtgtctatcttgctaatacagtggcatcattataatctaaattatacaatttaattacatgtaacttgaagctgaaatattggtgaggtacaagtatgacctttacatcacttattaatgttttttcaaatgacatgacactcagaaaaatttaacaaaatcttatgtttttgaatcggcttatgaatcggctaaataaaaccttaagacactgacaaacccagttccaacctttgctttgccatttaatggctgcatgatcctgggaaagatatttgagtactccaagattcacagtccccactctatagagttcttgagaagagtgaaatgagttaagcatctaaaatgtgcctcccaattactagccaatattagctccctcttcctccttcctttgccacaaacataccaggaaaaataaaattctgttttagatctgataaataattcctgaaacccagcatagcaaacataaacacactgtcctaaaatacatgggcagcatagtgtgtagccatcatgagccccgcctgcttgctttcccactgcattatgccctgagaaattgccccatgtgttttctggtgtttgattctgtgccagagccattagggtagaagaatgagaaggagttgagttcagtcctttcagagaggacactctcctttgggcatctgctggttatgagggagcttcttgccacaattcaggctgcatgctgctggcagagggaacgaagggaatgcactgtcagaaggacagagagacagagaagcagacagaagcatggcgatggccaagtgttctttagggagaaacaggctacatacgggataagatttttggaacatgaaagaagggttactttaccaatctgaggctgctcaggcagtggtgccagaagtcacagaacatataaagcagagtttttcctcatgcagtcatccctcaagatccatggggtgttgcttccaggacccccttagataccaaaatccatggatgctcaagtccctgatataaaatggcacagtatttgcatataacctacacacatgctcctgcttaatttaagtcacctatagatcactaacacctaacacagtgtaagtgcgatgcaaattgttgttgcattgtttaaaagttttatgattttttcttattgatatttttaattgttttttcaaatatttttgatccgtgcttgattgaatccagattgcggaacctatagatagagagggatgacttgtttttttccttctgttctccctttattccagctcattatttatttcatagaatctcaggtttggagaagtccttagagatattttggctcaacctccttctccatgcagaaatctcctttacaacattcacgacagatggccattgtggtgttgctttgttataatttgttttatttagtaattggtttttatagaacaccattaagttaaacagtttatttttcaaggctccatggaaatggctctctttaccatctgtgtgtgcctctcatatgagattagaccctgggactttctgccccttgatggcctgaactattagtaagggcagaaaagggaaaaggacttgcctcacttctcaatcaagactcctgggtaagattcagtgccagggaacggggagggaagggtagcaatgatttaaaagatatttactagcttgagaaaggtcattctgaccttcggtgttgtttctttaaaaataatactatttgagattttctgattatgcaagtaacccaggtgcacaaacttttaaaaattattctaaaagcacacaaaattactaaatatttgggagttctgcgatgatactgcttcttcagttttatattctgccctttttacattatagtgtgtcattacatgttcttccataatataagtcctagttatgtatcatattctgtttcatagctgtggcattatttacttaaccagccccttctggtttcctctcacctcttgcttcctcatgctggtcagaaaagctgcctctggcataagcacttcttaatctgccttgactttcatccagacacataaacgcttgtcccaatgcatttggatggaatgatacgattccagagtgtttcctgggagtaatcatggtgttgctgcggagtccatctttgggctttgtgtagttgatgtgttaattacactctgtcaagccacaaacttctattccccaagcctctccaggcatgcacaatcatctgtgtgtcacactgcaagtgaggataagtctaaatggaccctttaaatcagcttggctgccaactttggctctattgacttgtcagggcccaggcaatggcacagccagcagtcttggcccatattgaccagaatgggctgcagcagaactaccagcctcgcatcctgtgacaaacgacccaggacaatgggtggtacctgggctcccgctctaggagcaggcagtcctgctaacataccaccgcttccacccctgtctggctctctgctggccctgatccaaatggggcattgtgctttgttattgttgccataagaagtggcagcagggcctggaaatgcaaggtaaacatttgcaatgggattccaggggcatctccatggcctgatgctttgaggaggacagaaataggaatactaatgtcccagaatctgaatctgtctagaactgactgcttattgatgtgggttattttgctctgtaaagggacacacacacatacacacctcaaccttttagaagaaatcctgggttaataatactccacctgctggttccatctctgagttccccattcttggtcccatttggtcctgactgaactgctgaccatgaggctgacctcggcccttggtccttggtccttgacagtcttgagtctgatgacctccacctcctcttcacatggctccacattgctggatattgtcatcttgcttcctctcacatcctttgctagatatgactgctggtttcaagaggggcccttgggtgtcaggctaggagttgttgcataaaagaatcccctttgggtcttctttgtgatgtgctttgtcactgggacttaagcagtgctgcttgtgctctgagtctcatgacagcaatgcccaggctttagcatgtggctctggagggagcaggcatgggccttcaggaaccagagcaggaaaggaagacaaatgatgatgctgtggtggcctgtggtagcaattgattctggctttccgctctctcctccctagttacagaccttgtcttctagctgaaaagacaggctcctgatccaggcctagccaatcacagtgcccctttccctggacacagcaacagcccaggcgtgggtgtgagtcccacacagagttcatcagagtctgtccctgggattgattcatagatgttgggagagaaaggtgcttcctttccactgggtttgctaagcaagggctgccatgtggtgtgccatgggttacagagaaaacaaagctggtacataaaagagagcagagacagacaaaaatgagagacgggaaaagagaagcagcacagcagaggtgctgagcactagcatggccctcgaggctgctgtgccctccactgctacttcaattacatgaaaagctgcagcatctttctcaacaatgggagcccattattctctcgtctttcataagcgagtttgtgatgggctctgacacacatggccgaaagggccctgcctaatgcactttctgatgccagcaggtgccagtttgatttgtgaatacagatgagacatccctccaggaactttaggaaatagcataaggacactttgaggaagacccatttcctgcaggcaagcaggatgaagtcttctgccataataatttggattataaaagggaagtatgaccttgtttggatatcataagctggtgagccagaaatatgtaggctattctctcaaaaattcatacacatctcttaccagattggcttctggctggacctcctgcccccggcccaggccccaggccatcagacctgcttagaaacttgtctgaaactgagccatggaggtcgcctgagctggatgcaccatctacctcacccaactcaacagagagaagttcctgcaagagaattgtgaggttttagtggacaggtgaatgtagagcaggagaaataatcaggagtagcatcaagattggagactggggaggcaggtgtttggtgaatccattaacctagagaaaagattattaagggaagaggaggtatgtgggagagactaacttagagttagatgtattacacacacagtaggtgcagaacgcctggctctactgtgtctgctgtttcaggaggtgcttggaaacataggtctccctctcagaaaagagctccaggccagcacatacacatgtgtatgtgtgtgtgtccccttacagagcagaataacccacatcaataagcagtcagttctagacagattcagattctgggacattagtattcctgactatttctatcctcctcaaagcatcaggccatggagatgcccctggaatcccatcacaagtgtatgtgaagtagaagtagacgtcactggagtgtaggtgaaatagaagccatgagggttgaataaaattgcttaagaagagcattatattggtttcccagggctactataacacattaccataaagcagggtagcatgaaacaacagaaatttattctcacacagtttcggaggccagaaatttgaaatcaaggtgtcagcagggctgtgctccccctgaagtccctaaagaaggacccttccttgactcttcctagcttctggtagttgctgtccatccttgccattccttggcttccatctgcaccactcctatcgctacctccatagccacatggccttcttccctctgtgccttcctatctctgtgtgccctctcctcttcttacaagcacattggtcacattagatctagggcccactctaatcccataggacctcatcttaactatttatatctgcaagatcctaggtccaactgaggtcacattctgaggttctcagttggatctgaatttggggttggggagtgctatttaacccactataatggtgaagagagaaaaagagaaagctaaaggcagaatcatgagacgcacgaacattctggtcgttagtagggaagtgttagcaaaggaaagagaaagagagagagagagaccacattcctagctgctgagaggccgggtggggatgcaagcaggtaactgtgtgtgaccatcagaaaacactggtaacggcagttgggtgactaactaatatatttcacccaggactagagtggcagtccaggatgcagaactttcggtgctaaaacccaacagtaccaagcacactggaatggttggacactctacctgggaaccagcagttctattagaactgaatgtggggagaacgcacggctgaagcttaatggcttggggaatgagtaagccttaagaaatgtacttgcctggggcgtgattctggttgcgttgtttttctgacaattcaaccacatttggaattttcttacgtaggatatgggcttgagtttttaatttaaagtcttcgggtaaggtcagctcagtccctaaccaccggacatcgtggaacaaccaagttattggagattaaagtgtccttcaactgtcatgaatgccactctgaccctccttgtctggaggggacctccagggcatgctatttaaatgaacccaattttgaaagttcacctatctctactgaatgtgatagctatcttgctctgccttcagagcacttatcttcaaagtattcagcgccaggcaaaagccttgatttttccttgaaaaagaaattgtcaggatgtctgaatccatccagacctttgcatgtgtgatttcattattcatagtcagcattcctcttctggcttttgatctgtagtttacagaatgtgtgcataaggaggctctctttcccataaactgatctctttaccctctcagcccggaataactttccatttattcttttgataaagcgttgatgccgtgagccagcatacattaaatttatcatgatacaaacacagcactacactcttatccagcccagatcagcaaccagatcactgccagtgcccctcaagtgtctctgatgatgaacagcaaaggggacctgtggaatttctcacgaccatcaaatctgaagaaggaattcttctgagagcagtttgcaaagtctatcaccagtatcctgactctattattagcttgcaaggtagttaaagatatcttctcagccttgactcactaataagcacttttaaatatatatcaaaaagccctcttaattaaaatgcttcaactgctttctacctctcttctgataaatgccaatatcattaacatggctgctcagaaccctgcctgcctctccagtcttgcctggccccagactcctctttcccttctgctacttcccctaagttgaatatttttcattcttctttcacctgcttatctcctactcatccttctcttgtcatgtcaattatcactttcttgaggaagcttttcctaacccaccccatgtcccatccacctacttgcccctgatccccaggatacgttagagacctttgctttcacagaactgctaccaagtcaagataggctgacatgtgaccatagcaagcaccaccaaaacctcagggtggatgaatgaggatccacactgcttgagacactcagcttccaaggccaagtccatgaacctgccctctcctgggagcgcacggtgtatacatgtatatagatgtgtatttataacccaattattgtaacaaattatttattagatatagacatccatatcttatctacatttcaagatagaagtactttggaaataggaagatactgtgtctgtttcacctttgagtctcccactgtgcctataatctgcactgacagacatgagatgttccataaaggtcaattaattaatgaatgaaatcatgagcaaatgatttttgaaatcattttttcttacatatttttgagaaatgtaagcatctttgtgttttcccatcaatatttttagaaagcttcatttttcaacagctctgattaataatataattgaaaagcaaagaagtctttttaaatatgtactgtataagtctgtgatacttttgatcccacagagagtcaattccatttagttcaattcagcaagtgttaagtgcctatgatgtcaaatgcctgtagtgtggcaacagaatgcttcatttcagtgggataatttgggatgaaaaacttctaaacacgtttcagctcctaagtctgacttcagcagtcacaaagcaattctcccatgtttagactatagccattcattcatttgttcaataaaactttattggacatctattagatatgatcatgactgctctggattagatctcttgaaaactgtgatacaaaagaagagattgtgcaaggtctttcccacttggaaagaaaagttaaatagataaagcacctgagtaagagtaagcactgagtaaaagacctgggtttaatttcccacctcattctgttgttaagtagtgaagtgagcttagcaagtcactccatagctctgggcctcaatttgttatctgtgtagtaagggcagtagactggatgatgtctaaagaatattagagattagaaagtcattgtcctggatggctcacaccagtcactggagttgcttggcaggaaggcataacagcattttgtacatctagagctctgtccctctcatggggcaagtgatggaagaatccagtggcaaagttaggtttagcaggaagtcctctcccaataccaggggtctgagtcccggtgccatgctttgtttacctctatcacttgcaaggatgaaaaagcatctctaggcctggcccaatgtatggaatctaattcatgggactagatattttattagcatttccagctgaatgagtgatttggggttggacaatgtgacagtgaatagatgacatattccttaactagtgagtatgaaactgcatagaaataagatttcacaatgttatgatattaatgtactttctaatattttacatgatccatatgaagacatataatttacagtttagggtagatgtacataggtaacaaaaataactggagactccttttggagaagtctgcaattggatcaattagcatacattcccttacaagtgactcaaaacccaactagcaaagacggaaattttaggaacatttattgtttacccagcaagatgtctgaagagggtggttccaggtgtcagggcctggatttgtgtctctgccattttcttgctttttcccagtcacaagataactaacacagctgcagatatcaaatcctcacatgactgatgactgtaactacagaaaggaagcaggggagatgaacagacctctccctttgtacctctctcctagtattagagagaaaaacacctttccagaagcttccccagctgacctctcctctgtctcagcagcaaagaaagtttgagaaagcagaaatctgtggttttcagcctctactttggaaggaagacaaattaaaagcaagttggggatgtctgtggataggctgccaaagtgcttaccagaatccatcccacaggccacccaccatctgtagatatctttcctctcccacagccactgtgggtggaatgctgtggcccattgtctgagagagaactccacaggatcatccagttactgtagctagcaccaaatcttgcacatctgggtgatttgtagtctccatgccatcacatctcggtgtagattcctacggtgtagcagttgataactaaaagaaaatgtgtctgcttcaaatgcaatgatgctgaagtttaatttacctttcattaaaacttgcaattggaaaaaagaatgataggaaacacaatcgtcactgtgggtttttttccccccacatatctagttttgttgatctagaataatgaggttgagagaggattaaactccttggttagcccatctggcagcctataatactgatctttgggaaaatgttcctcattcatgtcctctgtgacccacctgagacattagagaagacgctccccttagaaattgcacagcctttccagctcacttcgttttagatcaaggttttgggatcttgatattgtcttaggagttaaacagagctcaatggtcatagcctgttgttgaccagccttagagtctatctggtcatgcaattgcttcaaaatcttagtgggctttctgatatctttgcttcaagtcaatttctgcaactaatgtgtctgtttgggttctttaggaagcagaacactgagatggagttaggagtgtaagcaatttatttttaggtggtgacacttatgaaagctaaaagttaaggaggctggattggaaagggagaaccttcagactatgatgtaaatctcacacctgtcacaagagatggggtagaagtaggattgggcaggagaatcctcagactatgacacagatctggcagaagtctttgccaactcaacagggaactgcagagcaaagacagctcattaagagagctacacattgggcagaaatagcccggaccttggatgcctactgtacttgtcattatctagaagctgctcagaaacagtatgatttccactccaaagtggagcaggatcccaaaggaactggcggctgtcagctaaccactctcactgcaagttctttctcgaagggagatctgattagggcacctccatggtggccatggcccaggatctggtctggctgcttcatctgtctcccctctttataggcttaatggtggttgttctgaagcaattcagaataagaggttgggtgcagaggctctattttgatcagacctttgccagcagacttgccttctttgcctgtcgaagaatgatggatgaggggagtttgggaacttgggaatgttgtcagtcttatttcttgttatgtctatactcccctgcttctgactccagcatgtctccaaattatgaaactctcagttaattcagacctcacactactaacagagaacatctcagaagagttccttctctttcctccctcctgacagattttctctaatctgtgttcatcttcttcttgcaggactttgccaaaagcttcaagaagtagccaacataactcaacatccaaaatgtctcctgccatttcccttaacactacagcctcagctggcacgtgattggaatctcaaggcatgacaagcaagagtccaacgcaaatgtcttgccgccacccagcaagtgttacagacatccagcctattctagctggaccctcactgctctctgccctgccacctcaactcagccattctgtattttcagatattatctgtgctgctctatttactgcaactaaattcaaaggaatgtgtttggctacaagtaacagaggataggtcaataaaaaggattttatttagtctacaagaaatctggacaaaggtggttccagggtaagtttagcacttccatgacatcaaggcaccaggttgttatcttagccagtctctggccttcccctcatggccacaagatggctgccacagcttccagggttatcctcacctaacaacatccaaaggcagaaaggagggtcacagaagagtgttatctttgcatgcctccctcctgtgatcagagaagagaaatccttcccagaggcctactggcatagttctgttatactgccttcagttgcaaaggaagcttgtaacatgaatctctggcattttcattctttagagtgggaggaggacaaaggcggagagcgatttggagcacagccagacagcagcgtttgccatgggatcatgcctattgatcttagttttccaacctccaacttggaaatagataaaccatctgtcttcccttcctggggagtagcaggttatgaataaattatgctgccagagcccagagagtccttaaaacaaaatactgtcaatccaaggccctcatttcattaaatccatattagtttctattgctcatttgatggcatctgattgttctctgggatgggaggtattggcagaacaggaaaaagggagaaaattagcccaaatccaccttccccaccaccctcttcccccagtgctgaatagtcatgaggtccccaggtacttgttatttctggcgagctagtgagctgagtacacaagtccatggctgggggatagatatattccagaaaactctgtgctggagtgctggagagggctgttggagagaagacacattactgatggagcaaattcagccaccatgaggaagttgggacagtattggggggcactatgccttcattagcccctgaacctacatcttataaagctgctgatccacctttctgcacacattattctttttttaaaaatttattttaacaccaacgccacttgccaaataacagtattcttatctcacaataattttatcttcccaatttctgtaatctcaggattcttaaaagggttatgagaaaattcccttttgtttccagaagatgctgcctctggaagcaggcctggttgatggctgattgtagactcagaggtctaaaccagtcagagtgccttgaagaatcaaatgcagccacgtaatcattattgccatttctggcagaagccctttaaattggcccagccttactatgccaaagggctggggaagcaaatgcaaacaactacttgttcctctgtcctcatggactttcctctcaccatccctctcacagttcttgttttggtcttccctccttgggtcctcactgctttgccaacatgtctccactacatctctctgacaccagtttctgcttgctccctggtggctgggggcacacacacaggcctccactgaccacccaggcttctagagacctgactccttgggcctgctcaggttactcaagttcatcattacaagccaagaaaagaggttgtaattgtggatactgcctggaccttagaggtccagcttaacttgaactggcttcttcgggactttcctggatctggcttgcaacttttctagatcagggtcagttcctctgctaccctctcacattcctaacatctggctagtgctggtctggttcccagagatgggaacgatgcatgccctccatgccagggctgtcccaatgggctctctcctccacgggctgatggggcttctgtttgtgagcactgatctgactctggtttccaagaacacggaaagactctgcaatcaaaactcagctcagccccaatttcactcatttgaaaactgttaatcacaagatatttgtaccccagatgtcagctggggtccttttgacttttgagattcaaatgacattggcttcagagtatagtgaacaaaaatgtgagtcctacatatggctagccagttttcccagcaccatttattaaatagggaatcctttccccattgcttatttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgtctccagctttgttcttttggcttaggattgccttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttataagttggattcctaggtattttattctctttgaagcaattgtgaatgggagttcactcatgatttggctctctgtttgtctgttattggtgtataagaatgcttgtaatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccgtgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggccaactggatcccttccttacaccttatacaaaaatcaattcaagatggattaaagacttaaacgttagacctaaaaccataaaaaccctagaagaaaacctaggcattaccattcaggacatgggcatgggcaaggacttcatgtccaaaacaccaaaagcaatggcaacaaaagacaaaattgacaaatgggatctaattaaactaaagagcttctgcacagcaaaagaaactaccatcagagggaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaagaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacattcacacgtatgtttattgcagcattattcacaatagcaaagacttggaaccaacccaaatgtccaacaatgatagactggattaagaaaatgtggcacatatacactatggaatactatgcagccataaaaaatgatgatttcatgtcctttgtagggacatggatgaagttggaaatcataattctcagtaaactatcacaagaacaaaaaaacaaacaccgcatattctcactcataggtgggaattgaacaatgagatcacatggacacaggaaggggaatatcacactctggggactgttgtggggttgggggaggggggagggatagcattgggagatatacctaatgctagatgacgagttagtgggtgcagcacaccagcatggcacatgtatacatatgtaactaacctgcacattgtgcacatgtaccctaaaacttaaagtataataaaaaaaaatgtgagtcctagagtccatcagcccagatcctacattcgggtactcttcttaccgtgctctggtgcacgtgatttaatttctctgctttttgtctataaaatgggcataataatacctgtataagtttggggtgctgattcaataaactattgcaagtggagcattaagaacaatggcgagcatacaatgttaccattcgctctgccccatgaggaagaaagaccctgttggatgaacttacatttcttctagtaatctttggctctgagtttctgctgcagccaaaacagaccagtttcaggaactgtattgacatatcatgctctctgattcttttctgtattgtcaccccttgctcagtgccaccttgattccttcactcttccagatactttctgaccgataaagtcgggtatgcagaggcttcctgaagtattagggcaatgagaaaggatttatattgcggcattacacaacttagatttgaattgaagatatttagttcttttttcttttttgagatggagtctaacactgtcgcccaggctggagtgcaatggcactatctcagctcactgcaacctctgtctgctgggttcaagtaattctcctgcctcagcctcctgagtagctgggattacaggcgcttgccaccatgcccagctgattttttttttgtatttttagtagagacggggtttcattatgtcggccaggctggtctcaaaatcctgacgtcatgatccacccatctcagcctcccaaagtgctgggattacaggcgtgagccaccgcgcctggccagacgtttaggtcttaaaagtcctttgactccacagtccccagcctctagccctctcctcctctcttttctggttgtctttttccttaactttgcttatttctctgtctacttagaataaaattattaggggtttagcttctacaccaaaaattcctagtacagcactttcttgctcttttaaaaaaatttttttttgtttttatttattttgattttaattttttttaatatacttcaagttctgggatacatgtgcacaacgtgcaggtttgttacataggtatacatgtgccatggtggtttgctgcacccatcaaccggtcatctacattaaatatttctcctaatgctatccctgccctagcccccgaccccctgacaggccccagtgtgtgatgttcccctccctgtgtccatgtgttctcattgatcaattcccacttatgagtgagaacatgtggtgtttggttttctgttcctgtgtttgttgagaatgatggtttccagcttcatcgatgtccctgcaaaggacatgaattcatccttttttaaggctgtatagtattccatggtgtatatatgctacattttctttatccagtctatcattggtgggcatttgggttggttctaagtctttgctattgtgaatagtgctgcagtaaacatacgtgtgcatgtgtgtttatagtagaataatttataatcctttgggtatatacccagtaatgggattgctgggtcaaatggtagttctggttctagatccttgaggaattgccacactgtcttccacaatggttgaactaatttacattcccaccaacagtgtaaaagcattgctatttctccacatcctctccagaatctgttgttccttgactttttaatgattgccattctaactggtgtgagatggtatctcattgcagttttcatatgcatttctctaatgaccagtgatgatgagcttttgttcatatgtttgttggccgcataagtgtcttctttggagaagtgtctgttcatatccttttcccactttttgatggggttgtttatttttttcttgtaaatttgtttaagttccttgtagattctggatattagcccattgtcagatggatagattgcaaaaattttctcccattctgtaggttgcctgttcactctaatgatagtttcttttgctgtgcagaagctctttagtttaattagatcccatttgtcaatttttgcttttgttgccactgcttttggtgttttagtcctgaagtctttgcccatgcctgtgtcctgaacggaattatctaggttttcttctagggtttttatggttttaggtcttatgtttgtcttaattcatcttgagttgatttttgtatatggtgtaaggaaggggtctagtttctgttttctgcatatggctagccagttttcctaacactgtttattaaatagagaatcctttccccattgcttgtttttgtcaggtttgtcaaagatcacatgtttgtggacgtgcggcattatttatgaggcctctgttccgtttcattggtctatatatctgttttggtaccagtgccatgctgttttggttaccgtagcctggtagtatagtttgaagtcaggtagcatgattcctctagctttgttctttttgcttagaattgtcttggctatatggtctctttttggttctatatgaaatttaaagtagttttttctaattctgtgaagaaagccagtggtagcttgatggggatagcattgaatctataaattactttgggcagtgtggccattttcatgatattgcttcttcctatccatgaggatggaatgtttttccatttgtttgtgtcctctcttatttccttgagcagtggtttgtagttctccttgaagtggtccttcacatcccttgtaagttgcattcctaggtattttattctctttgtagcaattgtgaatggcagttcactcatgatttggctcttgtcttaaagatagttctagtcctgaaaggaactcaagttgcagctttttaaataacaaaaattctcctctatatatgttgatgatgataactaattatgacaatcaaatatttaaatggcactaataataaaatggcaactaccaactatcattagcatgtgttttacagcttagaaagtactttcaaattctttattgtctcatttgaatgaatttccttttcagtttatgcctggagtatttgcaaataagggctttgtaacagaggatggccacacatacacatgcacatgcacacacatgcagactcgtgtgtagcgctctgtttcatgtgatgctcatgtaaagctccctgagatagaaggcctctgtcaatccatagacaaagtcattggttcagtgtctattgatcctgggtcctgggctggtaaccctgacacaacaggccaccatgacgagacattacggccttactttcttagtagatatgtctatcgagtttctgaaaatacagaggatggatgggctcatcttcctctgggattattgggtcatttctcagcatgtctgaagccgaacaggagtgaggccctgatgaatcacagtcagcatgcacagttcaagcaggagaaagctgaaatttcaacaaagatttaagtacttccaagcacacagcctttcatctttaaggactaattcacagtgtgcattttatacatctttatagggtcatgttaccattcctggacccttatttcttggcaaattgggggtggagtgacatttataagtgaatgcattcagtggagagcttgccatgacatgtatttcattgggagaggccataaatattttttgcacacatctgtatatccatgtgatgcttcattttggaaagcaacaataacaactgcgtcattaagcaacagagaggctaatgcatcagctggcctagtaggaaagacaaacaaggatcatcttgtcaaatcaaaatggattgtgctttgccaccagctgcctgcttttttgtaggtcccacagttcaagggtttgaattgaacctgcagttgtaacttaggatattaccacatcaggcaactcaccagcatcctttctgccctccaaggtcccggccctgactgtgatgggaagttcctagatgtccacagtgtggaccaattattgcccaggccttttcaaagtgtccctaaatagctgctgaaatggaacacactcagacatgtccctaaggctcttggctactgtcatagcttttaacacactgcattgtaattgtcttgttgaggagaaaaatattttttcctctccatcttctgtttatggcagagttctctgttacaaacgacagattaacaagagaaaagcaaacatatttatttaatataagttttatgtgacacgggagccttcatagggaaatgaagacccaaataaacagttaaatttgaatgtttttgcagtcattttgatgaagagtggagcatcatggagaaatatgatagggcaacgagtgtgatctaatggtaacaaattggcagaacttagcaagcgctgtttattcagattcttctctgtgtccctttgccttcagagataaggatattcttttcctcctggtatagggagggtacctcccacatgaaagtcttatgacctgcttcagaggaatatcaagaaatccttcctaggttttatgacctgcttcaggaaagaagggcagaggaaggtgacagtgatcttcctgcttctgcagttttctcaaatttcttcagcttaaaatactgttaagtagtgtgtcctgaacaccactgtcaactggagaatcatggagtttgtaaattttgaaagaagagcttttattcttataaagagttgcagcctgcaggctggctgttccacaggttgagaagtgtagcctcccacagaaactgaaagcaggcacttcaagggagggaagaatgagacagaaatgtatgctgaatgggttagctaagtatatatattcaacaggttaaaagaggagctatgggccaggcacattggctcgcacctgtaatcccagcactttggtaggctgaggcgggtgggtcacctgaggtcaggagttcgagacaagcctggccaatgtggcaaaaccccatctctagtaaaaaaaaaatagaaaaattagccaggcttggtggcgggcacctgtaattccagctactcaggaggctgaggcaggagaactgcttgaacccaggaggcagaggttacagtgagctgagattgtgccattgcactccagcctgggtgacaagagcaaaactctgtctcaaaaaaaaaaaggtatgaatattcatgtaggggcatacatatgcatagtaagcaaacatccatccatcccatgtttgctttggggtggagccttaacatttaaatatattaaaattaggctttttacatcaaaaggtgaaatagaagacacagaagcacacagtgtgcagcctctgtaaaccagcctgaacaagtccacggtcagcagcctcttatcaggaaggaacgctggttgtttgttgtgttgaaaccacaaacaaggaggggagtctggcaagtctttcaaaagggcttagaaacccttggaaaagaaagtctaatggccattagtgggggagggggtatactgaggcatgtacgacctcccatcccatcatggctaggaactcagttttaaggttaccttggggttctcttggccaagaggtggtctgtttagttggttgatggagttaggattttatttttatttctcaccatcaatctgatcacatctcaatctccattattagatcaaaaactccatgaagacagagactatgtcctatttctatccatgtactcagcatctaatacaacacctggcatataataactaatcaataggtttgttgactgaataaatgaatagtcctgtcccaacagggcaaaggaattaattttttttttctgaatgaaattattcctctatgacaaagttcacctccttaaatttcctttggatcactttgtctcttgcattgcatgtaggtgatgaatattgagaacatttatacttcatttagtcattttctccccaaacagatatgacaatgaataattttatcataaaatcaaataaaaagtgaaagggaagtatattgggttggtagcatagaagaaaggatgcctgggattgccgtgaggctgggctcaatggagatgtatccttcagctaagaatgggtctcagccatctcctaggggctatgaaatgtggatggctgtgtttatcatgactagaaggaccttgtgtctcttaatgggtggggctcagggatgttaaacatcctgtaacattccagtcaaatctttatgatgaagaattttctgccttaatgccattaatattcaatataggaatcatcttttttttttttttttttttttgagatggaatctcactctgtcacccaggctggagtacagtgacgcgatctcggctcactgcaaccagcctcctcctcctgagttcaagtgattctactgtctcagcctcccgagtaactgggactacaggcacctgccaccatgcttggctaattttttgtatttttagtagagacggggtttcatcgtgttagccaggaaggtcttgatctcctgaccttgtgatccgccggactcgacctcccaaagtgctgggattacaggcgtgcgtcactggacccggcgggaatcatcttttatactttaagttagtttcacttcaggatatgccgtttgtttcctccctccaccttttttattcttttttccctttcttccttttcttccttatttcattcttttcttcccttcctccttccaaaacttactaaatatctactaagggaaatggatggtgatgcttacgaaaatgaatcagacataggcttggcctcagggattaaactcatgcaaggaaagatgtgacatttgtttaaaaataaagagaattgggcagaaagaaagtggagggaaagtaaaggtaaaatgttatagatcagaggagagagagatgtccctgatgttttaaatgaaatgcatcttataaatcaacatttcattatgttttgcagacctctatagtttacaaaggcctttcctatatgttctttcgtttacattaatacttactgtaacccaacaaaggtactttatttgccctcagatttattcctcactgtttctctgctctgctttgtattagcaggggccagaccttgcaaactatgcccccatccttattagctggctgccatctgggtttagctaataggaagcaatgggagatagagccttctcccttaagcagcaggtagctgctgcttctctggcggtccacttcctacgagaaaagccttttgtgtctggactccagaactctgcttcttcccttttctctcctgctgaggagtagtatagcttcctgttgttgaaatctctggtttactccaccattcccttatgactcttaaagtctccaccacctgagtaagcaatactttgtattaaattccctgggctgtaaatatctgaaagggattttgttttttaaattagatcctaagtagaaagaaagcactactcttaccactttagagataaggagaaagttaaacgactttcccaagttcaaccagcaataagaggcagagtccaggtctgtctcctgactccaaatccaggcttttatccactgcctcatactgcctcccttagagactataacaatgaaaacataatacaaataaagacttttccaagatcatataaaagacatatcagattgtagaattttgttttcccctgtgtgcctttaaattgagatgagcttcttttgtttttattgttcttgggaaaagttaatgtattagctagattaggagaatgtaacacaagtacatatggatattagcctgacatttgacaaagtcattcacgatagcctactggaacaatgcatgttggtacagtcacatggattagtaaatatttgatgcaaggttttaaaaagtccacatagtaccttatgctgtcatatctcataatatttctacgattatcattatgacctcaccttggaatgaggaaaagtaaaagtcatattgaaaatgttttcagtttagaaagctttcataaatatatgaatcagagatacatttgtccaggttaccataccctggctacaaggatattttaattatcaaatattactaaattagttactgaatgttaccaatcaccaaaataactaatttactaataattataaagccctattctctgaaaagaccttatggggatggaccaggatctgaagtaagggcttggggatatgggcctggcaaaaacaggaagtggagctctgtgagaaggctcagtttggaggggctgcttgttcagattttgctatgatttgaatcctattctttctcctggagaacaagaaactaagaatgggaatccagaagcatcaggtcacattccaagagtggttacttacaccacatctgtcatcagccaaatctattctgccttgaaacagaggagagaaataagaggaggggcatttgagccttatttcataaagtgcatggtgttgaatgctaaattatccatgtctttgaagggctgagtttgaatgagttcacatatacatcccagtgattctcaactgtggatcctagataacatttggaaaattgcagggttgtttttgttagaaataatcgctacaggtggttcagtacatgttagttgttacgacagttccatacaacaaagaattatcctaaaattatcacacctacctcctaggtgctacgtatggtactctgttaggattgtctgattaattccatgaaggtctatactcctggggtgagggctgtggctggggtctcccctgaaaaagaaggacttcctaagtgtcgcttttctggagaagaggtgatttattaggtaaaactcccagaattatttggtgcaaaacatccaagaatgtttctgcttggaacagatgtaggcccacatacaaaagagggtcaacgtgagatcatattagagaagctggacttatgaccaattcctttgggcggtggaagtaataagttgacctatttcatctaactccactaatgtccacattgttaggttgggggaatgcgtgagtcttcctttgatgggtgtctcttaggggctgaagcagcctccaatgtccaggtggtgatggcagtgatgtaaatgaaagagctgcaaaggaaggcaaatccagagaggaaaagaaaacaactgcaaaggtcattcatctcttctcatttggggaggagtctcctcccattgcctactttttttttttttttttttttgaaacagagtcttgctgttgcccagcctagagtgtgatggtgcaacttctgcctcccaggttcaagtgattctccagcctcagcctcctgtgtaggtgggattacagatgcatgccaccacacttggctaatttttgtatttttagtagagacgaggttttaccatgttggccaggctggtctcaaactcttgacttcaagtgatccacccgcatcggcctcccaaagtgctgggattacaggtgtgagccactgcgcccagaccattgccaactttggaagattgaagtgttattatggtatggctagatgttcatcagtcctatttcctcttcctgggcacatagacaaaatttccagcacttggtttggagccatatgactggtacggctcataggatgtggttgaaatgatatatgacacttccagacctggcccttaaaatctcctgtgagattcttgactctctctctgttccctatcttcatgtacggtggagccattctatgggaacaacccagtttcctagatactggttaaagcaaaactgtctagaggagtcacaaccaacactggactgatacatgattgcaaattaaacttctgttgcattaagttactgagatttgagggtttatttgttacaacagcatagcctagtttatgtaccacaagtttgaaagggcattaatcaataaactgtggctgattcctggagaaaagtgtatagtggtatatgacaaggctctgctttctgcctgttaatgacctgggtgagaacactggtagaatactgatcaaattggaaactgataggaaacaggaaggaatacttcgtgtatctggtaataacataagaatatttctaaaaataactagaagattttaaacactgaaccaaatcaaatacatttctgtagggctaaatggaaactactacacttatatccaaaaagcctatcttacaagtatagaatagacgatatgtgaaaaatgacttcaaggcttaaagtgacagtaaggtcaatatgagctaacatgttgcagttatgtgatataatcttcagctgcattaatataaatatgaagtctgaaactgtagatagtaacattattctattttttagtgattgaaccaatactgtgctctctaaatgcttcagtttaaactttaggactatccctgtaggaaaaaaaatagtcaccattattgtaggagcttgaattaatggtatgaggaataatcaaaagaactggacaggtttactttggagaaaacttacttaaagggaccttgataatcactgaaaatacattttattgatatacttcacataccattacactcgctcttttaaattatacaattcaaattttttttatatattcacaactagatagatcaccactatctaatttcagaatatttgcatcatccaaaaagaaaccctatgtacgttagcagttacttcctacttccctctccccatagtttctggtaattgcaaatctgctttaggtctctatatatttgtctattctgagaatttcatacaaagggaatcatgtaatacgtggtattatatgtctcacttctatcagtgagcataatgttttgaagattcacccattttgtagaatgtatcagtacttcattcttttttatggttgaaaaatattgcattatatggatataaaacattttgtttatccattcatcagttgatgaatatttgggttgtgtccaccttttggctataggaataagtcttccatgaacaatgcttctattaacacacattttaaaaaaattttaagttctggaatacatgtgcagaacgtgcaggtttgttagatagctatacatgtgccacggtggtttgctgcaccttttgacctgtcctctaagttccctctccttgccccccaccctgcaacaggccccagtgtgtattgttcccctccctgtgtccatgtgttctcattgttcaactcccacttatgagtgagaacattaacgcacaattttttatgtgacatatgtttttagttcttttgagtattgatatgatttggctgtgtgtccccagccaaatctcatcttcaattgtaatccccacatgttgagggaaggacctggtgggaggtgactggatcatggtagcagtatccctccatactgttctcaagatagcaaggtacttctcacaaggtctgatggttttaaaagtgacaggttgtttttttttcttgttctgctctctctctctcttctgtcaccatgtaagatgtgccttgcctccccttggccttccaccatgattgtaagtttcctgaggcctccccagctatgcagaactgtgagtcaattaaacttcttttgtttagaaattacccagtctcaggtagtatctttatagcaatgtgaaaatggactaatacaggtatatacttaggaatggaaatgctgggtcatgtggcaactccatttaactttttgaggaactgcccaactgatttacacatcagctgtactgttttacattcccaccaacaatgacaacagtttcagtttctccacaaactgtctaacacttgctatcatctgtattttttattagaaccatcctagtggatgtgaagtggtatcttattccgacttgatttgcatttctctaatgattaatgatgttgagcaccttttcatgtatttattcccatttgtatatcattttttgagaaatatctattcagattatttcccaatttttattgggttatttgtctttttattatcgagtaatacttcttttaatattctggatactagaccctgatcagacatataatttgaaaatactctatcccattttgtggcttctttcaatttcttgatagtgtcttttgatacataaattttttttaattttgaagtccaatgttattttttctttggtttcttatactttacgtgtcatctctaggaaatcattgcctaatgcaaggctgtggaagatttaacctaagctatcttcattgtccataatttaagtctttgatgcattttgagtaaacttatgtttgagtaaatatattttgagtaaaaatatggtataaggtacacacccaactttatctttttgcatgtacatattcagttcactatttgttgaaaagactattctttaatttatttacatcctgatgtattatgtcctttcttctgcttgctttgggtttaatttactattctttgtctagtttcttaaggaaaaagattaggtgattgattcagaatcttatttcttttttaaaatacaaatacttacagctgtaaatttcctcctaagcactgctttcatagcctcccttaagttttggtatgttgtgtttttattttcatgcaactcaaattaatgtctcatgttttattttttaacccattggttattgagaagtgtattgtttaatttctagatatttataaatattataaatttccctctgttactgatttctaatttcattccattatggtcagagaatatactttgtatgatttcaatcctttaaaaatacattgaaacttattgtatgtcctaacatgtgttctatctcagagaatgttctatgtgtacttgcaaagagtttttattctgctacttttgggtggaatattctacagatgtctgttagctcctgctggcttacagagctgttcgtgacttctgtttccttcttgatcttctgtctagttgttctgtctattattaaaagtgaagtgttgaagtctccagctattattgttgagctgtctatttcttcaattctgtcagcatttactcttatgtattttggtgctctgttattaggtgcataggtgcaaaaattttgttttgtattgcattgaattgatacatcaatttagataaattgtcatcttggcaatattgactcaatatgtgtatataagggtacttcaaaacatttgtggaaaaaatgaaattcaaagataaaaagtataaactttatttccaatataagctccatcaagttcaagatatctttataagttatggtatcagtcatttagctcatccctaaagaattgagggtcttgggaatttaatcatgtcaatgcagtcattttttgtaatattaactgaagaatggtaggtgccctttaaagatattttaagataagaaaaaaaaaaaaaccagaaaaatgtcagaaggagccaaatcaggtctgtaaggtggattcctaatgatttcctgtagaaattttcacaaaattgtccttgtttgataagaagataggagcattatcgtggtggagaagaactctggtgaagctttctcaggcatttttctactaaagctttggtaactttctcaaaatactctcatcataaggagatattattgttctttggaccttgggcaacccaaaaaactgttgccatgacctttgctcttggccagtctgctttggctttgactgaaccacttccactttttggtagccatagctttcattgtgctttgtcttcaggatcatactggtaaagtcacatttcatctcctgttacaattctgaaaagaaatgcttcaggatcttgatctcagttgttttaaaattttcgttgaaagctctgctcttgtctgcagctaatttaggcacaatggttttggcacttattaagtggaaagtttgttcaactttattcttttagtcaggattgtgtaagctgaaccaattgagatgtctatggtattgactattgtttctgctcttgttggtcttcttcgattagagtgcaaacaagataaattatttccctgaaagaagctcttttcaaactgacgtcttatacttcttagtgcatcaaataggattcggttcagacatgttataactagtacaagtttatttttgtgcaaaaagattttgaaatccattcatagttttttcataatacacattttccatgaactttgtgaagaccccttgtatggtatatctctccacttatttagatattttctaacttatctcagtaatgttttattgtttcctatgtaaaggttttacatatatatttttagatttttttcatatttattacaaatgggatgttattgcaaatggaatctctttaaaagttttattttcctttttttctagtacaaagatatataattggtatatttaccctgaaactagtacttataaatcataaattttagtagctttaggttactttgaactttgtacatatataatcttaccttctagaataaaaagaaaaaagcaaccagttgttttattttttcctctccaactcttaaatatttatttattattctggctgcattgtactggctataatctttattacaatatgaatataagtggtgatgtcaagagtccttgattcatttcaaagctcagagcaaaatctttcaacaatttaccattagctgtgaggattgttgtaggtttggataggtattctttaatagatacaggatattcctttctattctttgtgaacaaagaggtttttgttttgttatttttgatttttttgtttttgttctcccctatctgactgtcatttatttctacaactcctcgagagaagtagtcataagtggcctgttccatcttcataacagagaagggcataggatacttaaagcctacctattcaaagcatgaattacaatatattccacaatgaaaaagtgatgactatctcaatttcgaagttgattgttaagcaacacaggcttttaaaataaaacaagagcccattccaggggttgcaaacgggtgaccagtagggtaaatctggctgtagatggttttatctggtccacagtagttttaagcttttgttttttcttaattcttcaccagggatacaaaaattttacatttacatctgtgatttctgccttctcttttttaaaaaagttggtaatgggccttaatgcaaaatcggctggagaataaagatcccttttttacaagacgtgttcttaaatttgccactgatagtcacatatcaaatttctccttctaattttgttgtatagttttgaatctgggcagactatctgcaatttggtgaaaatgttgtttagtatgtaaataaacaaaaacacctaaattttacatggttatagaatgctgaataatataaattgaacgaaaacagaaaagatgaattaaaggacggggggtggggggaagtttgaacttaaagattccaaagcaagtgagaccatggtacatagtttagaaaatgttatatatgtacaacataaggtggactctgaggctaactttaggaaaacattagtaatttgtgagggaaactgacagactacaaaggttgtttcctttatcttcctaacctatcaatatcccactttgatattaattcaaaatgtttaatgaaatgacttctctgatagttaagaaaatttacatattaaaacacttatttctgaggatacagtctatcatttgaatgagaagacccaaagaatgccttactaaacagtaaactgcctttaagtatatcatctgtgatcaattcagtaagactaagtttattacacttcaattccaggcataaaatgactatctggtaaactacaaagagctccttacaaaagaagtccatataattacagatattgtagaattccaggctcttctctgaaaaatgcaaaggaatcgatgttcgagtactacggtaatccacatctttctcaggtcagactataccatatactgcagaaatgtttaatcaattttggcagctcaggccatgaagccccaccacaacatcctgaactgttacagtctaactcttgggtcgctgttaagaactgtaggatcttcaaggctttctgggaagctttgctcagtttgcaaatcacataaaagggaagagttgcctcttcctgtttgcctggcttcccttctgggattgcttctcttatcagtttcaggctctttggtatttctctattttaaagatttcaaagggatgtgtagggcatgagtcaaatgacacatatccaccaccatttgaggcctgatgtcccccgtaaggttggttgtctcagaatccagaagtggcttatagtctgtgatagaaatccaatcctcagcaactgcagggagcagcactgaggacccacagaaggccttgtagtcttccagatctgtcactgtgggcaggccccacaagcacactgcaactgtatactatggaaataccctatgaacacatctaagagtgagaggtgaagccagttggacttctaggttgggtggggacttggataacttttctatcttacaggaggattgtaaaatgcaccaatcagcactctgtagttaggattgtaaaacgtgccaatcagcgctctgtggctagctagaggtttgtaaaatgagccaatcagtgctctgcggctagctagaggtttgtaaaatggaccaatcagcactctgtgaaatggaccaatcagcacactgcaaaatggaccaatcagatctctgtaaaatggaccaatcagcaggaggtgggccgggacaaataagggaataaaagctggccgcccacaacaagccaacagcaacccactagtccctttccaggctgtggtagctttgttctctcgctctttacagtaaatcttgctgctggtcactctttgggtccgtgccacctttcagagctgtaacactcacaggggaggtccacttcttcattcttgaagtcagctagaccatgaaccggcaggaaggaaccaattagggcacaagagcaacaggctgctactgcaaagaggcccaaacagcagagatctcagcacttccagcatccgcaggcaaccctacatgttgacccctgtctcactgccaccccctgatgttccccccacccacgctccatctgcccggttggaagtggtttgggggaagaggaagggatagcaagtggtagactatcacgtggtcccccaagcacaggagaggttggccagcatttattaaccacgtggtgaacggcatgttgtctgaacagtcaccatcaggtcctagcagcaggccagatcagcgcagtgtcgtgagggcccggacttagggaacgcatccatggccaaggtgaggtagcagaagcagaaaaggccaaggcccagcaggccagccagcccctcaaactgcagcccgcactgctggtacatagtcgttgtgtgcaaacttcagccatgccagcgcaggcagcactagctgttggctgagcgcagtctcgacttggtggccttcggaagaccgaaccaggggctcgggctcaggctctggctcgtgctttaacagaagcctccaccggtgtctgcttccgcgaactgagctcctcctcctgctgggcaacttcagttgcaagatgagtgtctcctccctagaggccatggtttggaagtcattttcaatacaatgatttcaatacatacattcaacacatacatttcattcaatacattgatttttgaatgtgaaatccaactttttttcttaaacccaaattgttcatggtgtgttatcatttttgtagtttgctatatttgatttactaaaattttgtatatcatttattgcatctgtgtaaatgagagagctggagctctagttttattgtaatgtcactggcaaattttggtttcagtgttatgctgtcctcataaaatgatttggtgagtattgtctcttttaatactttacagaatttgtctattttatgtaattttttccataaatatttcatggaagtcactggtgaattctggatctagaattttcattaagggaaggtttcaatagatacagaactattttgagtttgcatttcgttttgataagttgcactttccttagggtttatttcatctaaaattttaaattaatcggcccaaagttgttcacaatgatctcttatgagctttctaatgtctaatgggacctgtaataatgtacgctttctcagccctaattttagttgtgtgagcgctctctatagaaactcacacccctgaccagggctcatttttttgggctggccagctccagccctgggccaactctagccttgtgtctgtttttataaaataaagttttgttgggacacaatcatacttattcatttgtatattatctatagcagcaccacaatgccagagatgaggagtttcacagagaccgtaaagtctgcaaagaccaaaaaaaaaaaaaaaaaaaaaattttttttatctggtcctttacagaagaagttattttattcctgatctaggctattagtctactgaatgaaccaactttttgtcttagtttctcctctcctatgtttatttcagtaatatcttttattttttatttaaatttaatttgctttttaaaaacttcttgaaatagtttctcagataaattgatttccagttcttcttgactggcttattaagccataaatttccctctaaataaggctttgactgtgattcataagctttgatatattttcattatcatttagttcaaaatattttctaatttgcattataattttttatttgaatcttgggttatttagcattggatttcttaatttccagatatattttctagttattgtttgtttttaatttctaggtgaattttagagtcccctgggaatacagcatgtatgattttttttttttctttgaaatttttgagacctgccccattctccaacatatggtcaattttggtaaatattctgtgtgcacttgaaaaaaatgtgcattctgaaattgtgttcagtgttctaaatatgtcaattaggccacgttttgtaatcctgttgcactaatctgtatccttactgatgtattgtttgcttgttctatctgttattgagagagttatgttataatctctcattgtaattgtgaattttttacatgtccttttacttctgttattttggctttacatatttttcatacaaatatgggttaggtacatataacttcagaattgtatgtgatcctggtggattaaccattttatcttgtgaaacatccttatttatctctggtaattaaccctgcctcaatgtttattttcctgatatttaataaattgtagcagctaattctttgctcaaaattccaatgtcctatctcttccttctttttttatctgaccaatggattcacacatcacacaattctttactttcaatatttaaatgctcttataattagtacctgtttcctatcagcaatatatggctgatttttattaagtctaatctaccagtctttatatttcattttcagtatttagtatagatttatgtatttactgatatattttagtaaaggctatttttcccacttgttatctttctttttctaatctttattgactcttttgaattatttctcataattcaaatgttctctgttaatatttatgttattttagtagttatcttaaattactgactttttagaaaataaaacaatgcctttacctctcccagacaatgtaaggactttaaatctattccctctccatcaacttacgtgatattgttgtcatgtgtgttgattctatataaattttaaatcctagaggatgcgattgtgttatagagtcagtattcttttacatttacccatattgtcactagttctattggttgttactccttttggcatctccttgcttcattgagaagtcatctttcttcaacttaaagaatacgtcagtattggctgggtgcggtggctcacacctgtaatcccagcaatttgggaggccacggtgggcagatcacctgaggtcaggagttcgagaccagcctgcctgcccaatgtggcgaaacctcgtctctactaaaagtacaaaaattagctgggcatgatggcgggcgcctgtaatcccagctacttaggaggcagaggcaggagaattgcttgaacccgggaggtagaagttgcagtgcactaagatcttgccactacactccagcctgggcgataagagcgagactccatctcaaaaaaaaaaaaaaaaaaaaaaaaaaaaggatttcctttagtgtgaagcttctgtggtggttttttttccttagctttgtttgactgaaaaatgtctttatcttcttttttttttttttttataatgagactttatcttcctgcctttctaatttcctcctggtttttattttcaaaattttaagtgtgatattttctaggtgtgatttccttctatgtatctttcttgtggctaatggagcttggttagtatcctttttctgttggaacattgagggtcatcgttatttcttcagctgttacttttgctctattttctctccctggaactcccattataggtctgtcagacttttcaccatgtcccatttaattcttaagtttttttcctgtattttccatctttttgtccctttgtgtcaatcaatacattttattttggcctatattccagtttactaaacatctttttaatagtatctttttcctttcttttctttttttttagagacagggtctcactctatcacccaggctggagtgcaatggtgtgatcatagctcactgtaacctcgaactattgggcccaagtgttcctcctgcctcagcctctcaagtagctgggacaagaggcgtgcaccttgaactgtacctaattggcttttaaatctatccatttggaatcatgctatgaggatttttttaaaacagctttattgagacattaattcacacaccatacaattcacccatttaaagtgtataattcagtggcttttagtatatttacatggttgtgtatccatcaccacatttcttttttacatttagaacattattagaacatttttattacctggaaaagaaaccctgacctcttagtcatcaccacttaacctcccatcatgcccacctctgggcaaccactagtctgctttctgtctctatagatttgcttgtttttgacattttatataaatgaaatcatgcagtatgtggtattttgtggctggtttctttcacttagcatagttttcaaggtggatccatgttgtaccatgtagcagtcttcatttgtttttatttctgaataacaatgtatacatgtaccatattttatttattcatctgttgatggatatttatgttgtttccatctattgagttttatatttcactgatagttttcagctttagaatgtaatttgattattttttatattttctggttctaactcttgtcagaacttcttgttaatttattgaacatatctagctgtgtcttacagctacagtatctggattgtttttgttgtcgctgctctgtttctgtttctttttctctcttttttttctctttagccttgcttttttgtatacctatttattctttattgaactcttcagatatttttcatgaaaaatggcagagataatttgtggctctggattatgctatcccctccagagaggatttactttgtttctggcaggcatttaggcaaggaagttgatgaccttaatccaatcaagcttgacttaagtgtgaggtgtggtctgttgctggttcacccacgcattttaggcctccaatcctgaaagcccagggtgcttaccagggccccttcttcttagtgatttccaagttttgactgttaaatctggagctgttaaaagcccttctctgtttctcagactcttagctgccaccttgactttgaacatcagtaacagctgtaagtatcaacgtgactctgaattgtgggtttacatttttttggttttctcctcttccatatctttgcctcacaagtcttactttcttgataggtctcatgtctttaaaaatatttttaaaatatatattatcctgcttctctggttattctcagccagaaggcttctttgaaactatctagttggccgatgctggaaacagaagtctacccacgaatttgttaagaatcatttctttcaaggatatggtaaagcaagcattcttacacatggctgattagagtataatctagttcacctctctaaaaagcagtgtttcagttagcccatggccttaaacacattataccctttgactcagccattctaattctgtgagcaaatcagaaataaattattagagaggcagaaaatatatttacatacaaggatattcactaaaactcttaatagagaaaactggatgtcaactaaatattcaatgataaggatgataattatggtacatctatgagatagaatagtctgtggtgattcaaaatcatgtattgaaaaatatttattgatatagaagaataagatataaagaggaaaatgatacatacttttcatgtagcatgattccaatttttaaaaaagttacatgtttagggaaaatgctggaaagatacaaaccaatttttaatgaacttaatgttagatggtgagattaagggtttttaaacattttcttctttatatatttttgtattttcaaaggtttttaatattgagtgtgtactatttttataatgaagaaaaagtcacaaaaaaaccctaaactcacttttaatctggcagattatattccattcttttaatacagactttagcaagctagaaattctttacatttttaaagtcttagaaattaagacaaagacacttgcagaaaaccacatgggatgttgctggagagatgacagtgagcatcttcatcatgctccagggagcagttggctgcatgactctagttgttgtttcaatagttgacagaggtttcagcctttgtagacttggtggtcttcagactcttactgattgaaaaaatacttctctacaaaagtacaacagattttggagtctttttcattgtgaaagtcatatatccaaccagattttattagctacagtttttgttttcaaaacctctgggtgttattagggaaattctcttcttgaaattcaaaattgattttccagctggacgcagtggctcatgcctgtaatcccagcactttgggaagctgaggcggacggatcacttgaggccaagagtttgagaccagcctggctaacatggtgaaatcccatctctaccaaaacattagctaggcatggaggtgtgtgcctgtggtcccagctacttgggaggcggaggcaagagaattgctcgaacctgggaggcggaggttgcagtgagccaagattgcgctgctgcactccagcctgggtgacaaagtgagactttgtctccaaaaaggaaaaaaaaaaaccaaaaaacaaaacgcttcaaatccattttcataagaaccaatttttcccactgttctttacagaacaggtcatttatgaagggatcttatcttggaagagggagggtaagaagagacagtttggttatttgactgattacatagcaactccatatgggatgttttatttcacattcttgagttaatccttaactaatttctcatatctgacctctgttttctttgaaatgttggtgaacatgtcaaacattcttcccacccacctcgacactttactttcttccccagcttggtttcagataactggcaaccttatgatgtttattgcttcagatatggacagtttaggaactatccaaagtttctcattgctcatctgtaataatacttttcatgatggcactagaatcctaaattctggtctgattcaggaagatggtctattttcatatttaaattggcctgaaaaaagtaaggccttgttgatacaggtaggggtccactaccctgaaatgttgctcaaaagcacatttcaattttattcaaaagctgctttgatgtgtattcccccaaagcaccttagctgaaaatcaaattttattttagagctttgtacagaccaatgtctctttctagcttcctgtacaccaataaaattgtgtatttcaatttaacctcaatctgcctgtgtttaaaatataaagctaaggttaagggctttcactgctagcaaccctacctggacatctctatttctagataaaaccttttactgagaacattttattagtcctgcagctcaacgctgccatatatgccagcctgtcctattaatccttagctacaaaaatatcagaatcatttatgagctaaagttttttttttttttttagctttttaattttctgagcctttgtggtattatttgggtcagtttggttgctggggctccacctcttcccacctgcccccaacccagtgtctctgagttggggagaagagtctcaggaccatggggaccaagaggctttagggctgaccacctactgtaactggctgtctcatgctggccccttggcctgatttgggatgcgagatgccccatcactttccttttgtgttgttcctcaagtcctggaatcccacagtagctcaccttgtttttaccacccttttctcttctttggggcctactgcactatttccaaattttatagtgtgtttagtgggaagagctgggagaaatggctctgcaccattttgtatagactagctctttttagctatataaaaggtttcttctattcagacttctcctcttgttcataaaatgacactctaccttcagagaccacatgtgattttaatgccaggattccaaggcttgttctctgtcatatacaaaaacaatgattaggttgaagtggtacagaaccttgaaatactctctggaccagttctccagctgagactcaggatcacctaggacccagttccagacatcatactcatacttcaatgtcatactcaaatgagcttggcagaaatgcataaatgtgttagaattagggcctgaggaaccactgtcatgcttctttctgccctttcatggttaacaaaaacagactgactgctgagccagggatctttgtttcttggaagattttgcctcacctaacagaagcttaggtgggttcttgcctcctaacagaagcttggctgtgtccacatttttattcatcaaagcaggggtctccagtgaagtgtggacgtcaccaatgggctttaggaatgtttggtggctcctggagaactggtagaacagactggaaacctgagtgtctcctggaaaacaacttcagccacatccactgctggagttcagacagaggcatatgctgttcttgactcttctctttcatttaccttccatatgtaagacatccacaaatctgttaccaccatcttccaatatatccagaatccaataacttctcatcagctcccttactacctccctgacaagccaccatccactctcagtggactactgcactagcccactagctcatctttcctcccctgtatctcccctaccccagaaatgcaagtcagatgatgaaactcatctgtttaaatccatccaatgttttccatctcattcagggtcaaatgcaaagttcttcagtggcctatagtgcctggcatgatctagccctgatactttactagtttcatttgcttcttctctcctccttgctcatttctctccagcaatgtcagtccttaaacgtaccaagcactcccccacttcagcacccttatccttgaatcccccaaccgcaatgttcttcccccacacatctgcatggctcactcttcacctgctcagatagcaaccctgtcaggttttgcagaccactctgtaaaatttgttctctactcttgggttgctcttaatccccttatcctgctctatttttcttcatggcacttggcatcacccaacatagatatgtatctgtttgcctctttgccccttatggaaatgagagataggactttaatgcattccttctgtgtatccagaacctagaacagagcttggcatgtgatgggcttccactgtttaatgaataaatgaaggagtaaatgaatcaagataacctcgtacatctcttcaaggtggaactggaaagcctcccagaggaactcgtcagaaagaaataaggcctacaagagttttaaccagtaaccgagaaaggtaattctgaaaacagtataatgactgtctttaggcccaatgcccactggacacatgtctggtctttggaaaacaataaggttgtaaataagatcagaaagattcatttacctgaactataaaatatgagtgcggaaacgacactgctgtgggagtgttgttcttccccttttgccaggcattagttttctatcctgtgtaacacaataccagacatcatcattatgtcacagttctgtaggtcagaagtccaggcagccttggccgtgttctctgcttagggtctcatgcagctgatgttagggtcttggttgagctggactcttatctggaggttctggggaaaaatctgctatcgagctcattcaggttgtggcagaattaagttccttgcagttgcagggctgagggtcccatgttttttctggctgtcatctgggagccactttcagcttctagaggcacctgcatttctccctacgttgcccatccatcttcaagcaagcaacagcacctcaaatccttcttgtgctttgaatctctctgccttctctctctaccattagctggcgaaaactctgcttttaaagagttccttaggtttatgttggacccacccggataatctttcttttgcaaataaggtagcataatcacagaagtgatagctcatcatatttacagattccacttacactcagaaggacccacactgtgagtcattcttagaagtccaccacacatcacgatccagctaggcactaagagggttcctgggatcagagtgatacctgatggaggagcagtggtccccactgtacctgcaagaccattagtgggggactgttttgccatggggcatattgaagagaaatgggctacttctgggagtggcagcaagatcctttaagcctgataggctagaggcacttgcaggaatagacctgtttatgcgcctatgatgatgactttatagagacctatagaaagacttgcaaagaatttccaaaggttaagtgatcctgcaaggccacagatgaatcaaatgtgagttattactgttcgagtgaccatgtttgtgtgcatacagtagtgaggactggaaaaatgttccccaggtcagagcagatgttagtgacttaatctaatgaagtcctgaagatctgaaggaccaatgacccttctatgtccttgtcctttcaatttcaagattctaaacctggtaaatagctaagccagtattcaaccacaggttgtcaagctcaaaagcccatgaattttctcaagaactctgccagggatgggaaatgggtggcatgcttaccatgacgcagcactcctgtgccctatcactgaccactcaccaccttcctgcagcctaggaatcatcacgactgctgtcgactaccactggcaattaaatcagagttgaaatccagggcagaacttaactcccatccctggagaccacactgtatctcaaattccagcaatgccagaaccagaaagatttccgccaatttcttactcagctgcaaaatcatatattgtaaatgttagaggaataccttgactctctctattgtgtacctttagttgaatctgactaggggaagggaagttaaaataactgaaatcttttatacatttttggactattaaacttataattctgggattttcctctcctagcttttcttttttttttttttctaagtatttcactgattaaaatgaatgagaaaggaattaaaatgaataaatggcaggaatgtagacccaaagaggatacactaaagccatttgtgctatttaaacttcttagagggaactgatgttaacattaagaggctgtgctctgttcccacagagaagtagccttaggcaagctgtcaggaagctcaagttgatggaagttactggaagctctgagaggcggagggggagggggttggggggcatctcttggatggtgcagcagctgtatttggaactgggaaggtagggaaggggctactggagtgtcatgtagtcctatattttgaaatgcaaagttatcttctttgtattgatatttctaggatgcattcacatgatgcagccatctcacactaaagatcagatacttctttccagatatttcttgttcagacaaccgagacaaaaagaaaaaccatacttgagcctcaaagacagcaaacggaggttactcttaaattggccttataagcccgtgatctaacccctacctactccaccatcacttctcaggatctgggcggaagcctcactggcctcaaggttttcggtgtggctgttctccctttggcctgctcttgcctacctctttgtcagactaactcctatttagtggtgcatgatagacacatctgatagcaataactcaacgtaagcataccctgagaatgaccctgagaatggcccttatggcagacacatctgaatgtggttttcaagctcgggaatctgggagcggccaacctggagattcattccttatctatgaggaacacctgagcccccagcccgttttccccccaccgccccggaacctgggtcagacagtggatctaggccctttgtgttgggttaaattaaggttgccaggtgggggttgttgggagagggtgctaagtgaaggtgctgtacaaactgcatgctttttaacaagcaacggtggttctcttgtctagcctgctgtcactgcaccatctctttgggtaagtttcccactgataaaaccctgtgtcttgtttgctggttctgggactcttccttggcttcttgaacttggtgttgtccctactgaagtgaatagggatccaacatgacaagttctcttgtcttaatttaggtgcatgccttgtggggctcttctctgccttgcaaaccttatcagatgccccagttacacacttgcctagagccttgtactttgcctcagtcacacttgtggttactgctcagtaatgcttattgaataattaatttattgtgtgctgtagttctttttataaatgagattgtcaatttcttgaggccgggaattaagtctctttcgttcactgctgtatctgcaaaacctcgctcggtatttaatactcagcaagggcttggcaaatatgtgttgaatgaattaccgtgagaaacaaaaaaactagaaccctggagcactggctatgataaaaacatgcagcaggtgggttttgttttcaaggcacttcttcctctggtagcatctctcttcctgcatacatccacacatgccaggctcatgttcatagggcttagctcccagttgactgttaggtatttcctcaactaacgaactgagttgacaatgaccagggctgttttgagctatatttggagaattttaaacaacagagatgtttctaaactttcagctgcttggaagattttaaattggtaaccaaggtagtgatctaggagatgtcatgtgctataaggagattctcccccatactattaaaggaatctccaaaatgaggccgcatagcagatgggggtaggtgggagggaaatttttgtggcagtggtgatgcaggtggagtgaattagatcagctgtttttgtttttaacagaaaattgtgatggttgaaactgtctgacaagacagctggcatttttattaaagccttcagcaactacacacctcaataatatgaggaggggccctgcctggttgattggtaggtggatggttaattggttgttttcttctggtcaagcttgactttctaaatgtgtaataaagtcataagacttccatgcgtttgcccgaaatgagcttttctggtcagaattaactatgtgtaggctggtgctcccagagtggttggtagacattttatttggttttgtgctcccccaacagggagtagcccttttaggacaggaagcccatttcccagatctgtgtccagagcctcaagcccagtgcatcacgagtcactccttaagacggatgtgttgatttaaacccaaacgaatgttttagaggagccgcctggcctggcctctctcactaccaagcgttggttggccagggagaaacaagtctgaggtgtctggtgtgcgtgcgcatgcgcgccctttctccttttttccttccgagtttttctctcctctctcctgcctttctttctcttctttcttcctccttgtctctatctcagtttctgtttctgagtgattcttgtctgtttctctcccttttcctccattctctgtgacatgaagggtttataagttgttaagtgcacaagcaacccttggcaagaggagaaaagagggcagaaatccagctacactatactggctgaggcataagtgctggcatgggattttgtctgcccagagaaggcatctttttctaatgtacacaaaagtgttttgggggctaacagcggccctttctttccctagaatattaccagggaaaacagtcattttctactttcctctggatccgggcttcctcgtatctcaaaaaacccgtcattaccctccttctctcatctgctgaccaaacctgggcaggttggaattgcatttctattggaaacgtattattaaaaaagtgttttgcagtatttagggcttgtgtctttttttctgcttatcttttatttttgttgggctcttttgagtagaagagctaaacttttaatcattttccttagatgtttccctctaattttctcttcccaattgtctatataactaaaccctcctaagctcttgttgatcctctggcagtgaaggtgtgtttatataacagtggtgtttgttccataatctctgactgaaaatattgagggtgggaaacctttgcatctgcaagctgcctgacaatcagaactgcagacagggaagttggcgttttgagaatgctcttgagattgaggtccatttctaattatctcttgtatctttagttcctggcacattgcttagcacataacaggcattcgtaaagactgctgaatgcctgaagaagtgagtgaataaatcctcctctagccacaggctatttaggagactcacactagtattaggagtagctggtataaatccaggtcagggcaggcactgtcccttacattccactgacctgagctgcagtgagatgatacttgtattaggctcttgtgagattcaagaaacaggagcatgctaaggttaaccccttaaagaacataaaatacatggaagtcagggagactggaaaccagctcagtatgtatagagaaggtctcccgcaagaccacgcagatcaagagagcaggagagattgttccctgacctgctgctccaccattgtgatgacagtgattttggcctgcctctgctattcccgttgactgctgcttgctcttctccaacctcacacctctgcctggtgtctggccttggagtttctcccagtttctgtggattctcctttctggtggctgtcactataggtcccaccgtccagctcttctgactgggttgtccagctatgtccaaaagaggtcctgctgtagaatgcagagcccttgtaccaggctgcatcagggacactgttctggatgtggcaagcccctcagacagggactattggggcaggcatttgaggcttcccagaagtacttgggctgtgcgctttgtgaagattgctgctgtatcttgagtgtcaaaccagaatgctttttcagtttacagtcatacctcattcacttagggctggctgtctcaggaatacttttatgatacacacaaatgcaaatccatgatggtgccaaaccttatgtagtcagtaaaaagacaaaagaaccccaggttgacaatagagggagcactttcgaagctctcaggcaggggcacctgcaggtcatagagacctagctctccttgatttagggtcacttttcctcagctgtgatctgtccttatgttcttcacccacaatgcctgacaaaagacgctggaggtacctcaaaagtgccagaggtggttttacgaagtttcagtctctttcaagaaaatgattgaggaaacagaatgaggctattagggattggcagaaattctttgacaatataaaagaaggacatcataagactcgtcgcagcctgggaggactgcctgatgatcatacagtattggaaagaatgatgttagaggttgtcaaacttcaggggatttgaggaggacagtcactgtctctttaatgattatgctgtaatgactgtgtgcattgcttatctcattttggggaaagcattctccccaccctcaagctatttcccaagaaatgaacacaggaaatttccaagaaatttcccaagcattctcctggacagttaccaggagaagagccctcatctttcctctgtcttcacaaaactggggctcactgacattttctttgccaatgtaaagggctgaatctgttctcttgttccacggtgagtgtcgccataagtccagatactgtttcccttctggggacttggcagctagcctgaacctcctgcctgggattagcagggaccgggggatggaggggaggctgcccaggtcattgtccttgttccccttgatctctccctttaagcagcagactcagtcactggcgccatcaatctagcacatttcataaacagtaaattcattttaaaaacctgctgctgagcagccatctgtctccatttttgtcaatctgctgttacagcaatgctagtgtactgtgaggttgtctttcattaaagactccttgatctgaaggtgagcacgttaaacatggagaggagctctgggccagctgacagcatttctgaccactagcctttcatcaccggaacctggagtttaaaacttatttttgacctaaaatgatgatattgatggtttctgtatcttgctgtgcttgatttacatactttaagattacagagtgttctaacatcctaacttactactgataaggtaggaagaagactgacaagtcttattaccatttaagtattactgtagataaacaggcacagagtagttaagtgcccaaggtcacgtagcaaggatgagaactgggaatatactggagctatggtctccctcctgaataactgagtcatctctatctgttttttttttttttttcatgtgaccatttcacaaaatctctacacatggacattttgctctccagagaccagtctgagcatagcaaagaggattggaaccagctctgagctgagttgtaggaagaagctgacacctggatcccaagccagtttttaatacataacatcctacaatgtattctctttgcagcacacaggacctctctccactaatcatttttattaggaggaaaacatattaaaaccaaaaaacctcaacaacataaaatcactgaaagcaagccaaggatgcagacagcaccagacgggattgtaggcagtggaaacactctcctgcaaaggaagcgtgttaacttacgctcaggccccataggcttgtcactagatgaaataatctgaaggaactcagagggtattttcctgtgcttaccacccctaagcacccttacaagccattttggataatagaagaagaatctaggtgggaagctggttcagagcccatcagaattccattatgcccatgatgttggcatgccctgttaacatgttaacatttagacctacctaaaataagtcagatctaatctccaagcatagatttcaaggcagtaagccatgctgctgttcattcctgcggcatcctgggttgtcactccctgcattgctccccaccaccttcctttgaggaaagtgcttggctttgacgtgttccctctagtgtctgtgctaatcctctttgtggctcttctactgctttgttcttatttttgacacgttgagcaaagcacctggaattggaagagtcagcttctctttgagcaatcagtggatgccaagaataatacttctgccttattcttgttccttggggtgatggtgaattctgtgtgtcaacttggctaggctgtggtgcccccttgtttgttcaaacacttgtctagatgttgctgtgaaggtaatttttagatgtgattaacatttcaatcagttgactttgaataaagtagattaccctccataatatggatgggcctcatccaacctgttgacggtcttaagaacaaagaccagtttcctaaagaagcagcagtgtttgcttcaagatggcaacatagaaattctgccagagtttccgtcctgctggcctgccctgaagattttggactcaaggctgtagcattgactcttatctgtatttacagtctgcctacctgccctacagattttggacttcccagacttcatatttgcatgaaacatatcttaaaataaatgtctgtctacctatccatccatctacccactcaaactatttgttctgcttctctggagagaggcacgaatacactaagcaactaatacacttagttaatttcaacatttccttctctacaaaggactagaagctaattagaacattctggagctgccccagccctgcctcttattagccctgcctcttgtgtgatcttggggaagttgcaaacatcactgcctctgtttactcaactgttaaataggagtagggtatttgctgctaggttgttatgaggattaaatgaggatgtgccacagagtaaatgttacgtttttaaaattaaagcaagtatattagaacatatccagcactttgggaggctgagatgggtggatcacctgaggtcaggagttcgagacctgccggggcaaaatggtgaaaccctgtctctactaaaaatacaaaaattagccaggcatggtggcatgcatctataatcccagctacttgggaggctgaggcaggagaatcacttgaaccttggaagtggaggttgcagtgagccaagatcatgccactgcactccagcctgggcaacagaacgagactccatctccaaaaaaataagaaattatttgatacaatatcaaatctattgatttgatgttgtaggcgtataaagatgttcatgtgtgttctagcatgtgaggaaggcgggaggaaatgtggaatgcccttcacgttgttcctgaatcattgcttctcgttttctggaggagtgtggtggtgtgttcgtaaaggaaaatgtaggggcattggaggtggatcaatccacccttaaatctttgttctcccatcttaccactttatgatttaaagcaaaggttactacctttttgagactcaggactttttaagacccttagtttgaccctagctctgtagaggtggaggtcttgagaatgtgcttagatgggtccgcagagaattcaccctgaaaaggaaggaactggaggacacaagcttggcacatgaccttgattagtcaccactaggacgcaagacttcaatgtgcctactccccaattttgccactaaattcatcccaaatcagtcaagagtgatggctataaaagcttggagaacattctccccagtggaagcctaatgaagagctataaaacctggtgaatagagcagcaaaaggtgttggcagtcgaggacaagtagaaaagagaaaagaactgctgttaaatgatgagggtttttagtgtgaacagctgttgagatgtctcagttggacacaagggcgggggcttggagggaagcttggcaccccacggtcattacctggtggtggtggtggggggatcaatttttaccaaaaataaaaatatatatttttaaaattttttttcttttctcgtactctggagcagctgttcttagccagtggagattttgccccccaggggacttttggaaatgtctggagtctttgattgtcatgaaggggaccagggttgctgtagtcatctagtgggcatctagagctgctaaacatcccacaatgcacagagcagccccacgagaaaatactcggctcaaaatgttagtagtgccgaggttgagaaatcctgctgtggcggccctccgtgccttaaatgaagagtaagcagccccggtacggactgttacactggtggcaataacagcgtaggagtcgcatggcttctcgcaggagagcaggaggctcaaatgtattttggatgtttcctctaagacgatgaattggcttgaatgtcttgtgtggtgctgtctcacccaaaccaggtgtatttcagaattgatttgaaaatgacttggagaccagttcacctattgcctcagcatgatggtaacatatagccaggacagagtccatgacagtaaaatggctttgatgaagtgactttgttcctgctcttcagctggggcttttggctcctcatttgatctccccagttagagtgcagactcagagtggccaagggctgcagatcctccctttcctgggcctccctccattcctcacaaagggcaggacctcaagaaagaaatgtttcatagaggaaagtcaccccctactttaatatacttcaacaggctgacaacctgaaaaaaaaattaggacaggaaggagaaaaccatctcagtgatgaatgttctaaaattagagtctacaatgcaggtattgtatttcttcagaatattaatataccctcactggaatatatcattgagatttcactggaaaattagaaagggcaagggaagagtttcagcctgaaggctattttgaatatcttaagtgattgaaataaacaaattaaaaaatgaatttgttatgttcggtactagatttatgacagggcagtacgtttgaggtcatttttactgtggcacatgaggaagcctcagaagatttctatgtcccaaagactgttcacaaaaatcttttccagattcttctagctgtatgggagcatagagaatggtgtttcctatcgaaagtgtttaagaggctgtcacttgctcaagatcatttagtcagtggctaagccagaactaaagccagcttcctggctgtgagaccatcaccctgtgctgctctgcatgccatttgtcatggtgtctgacattccacccttgacaggtagggagataaagagatgataggtatttggaatcaggcagatgtgaggatacagcacagttttgctcctccttttctgtggggcttacttaacttttctgattcttggttttctcatatgaaagtagagaaaataattattattagtggtttacttagctgtgtcatgaaaacgtctaggcctcgaaaagctccttactataatgcaattattacagtgactttttataacatagacgggtgttactcagattgtgattcacgaaacagttctcaagatgtgtttaagattttcaataattaatgtgtttcatggctaaataattgtaggagacaccagttaggtcaaggtaaacagaataggaattcttagagccttcaataggctaatgggtatgacttaataagagaatgtaataagaagcatttcacaaatatgtatgaccatagaactttttttaagtggaacatctgataatatcttgtgggatgctagtttccatgggacacagtttgggaattatggtaggttgattatattgatgtgtccactccttttttctgggctcagatacgtgacttattttggctgatcagcagttaactggcatgatgcaagcagagactgagaaagtccttgtgcattgaggcttgctgtcttgctgctctttataactacaaatcttaatcttccctggctccttcatcataactgttgtatcgaacccctgtagactccactggggatggtaccaggttcaagaggctgaagaagagacccagagccagggaatgagacatgagattttgctgggggcttacatacgggggagagagtccagtgttgacgggctggacagaattattgcatggcctagtggtggtgggctgggcaggagaatcacaactgcttgcaaaaaaacgtgtggcttttatagcattttcacttaacaccctttacctgacagcctccacttggcaactttcatgcaaccccaatctccatgtttcactggacagatagggagctcagatgttcctcatagacaaggaatgaatctccagattggccactcccaaatcccctagctcagaacacacattcaggtgcacctgccatatagggtcattctcagggtgtgcttaagttaatgctgtcggttggcatttaccatgtgctaaccatgagtatatgctagggttagcctcctggaagaatgagaaagatgtggggggagagtgggattgacaaagctgaggtcatttgaccttattgccccaagataaccactagccaaccaccatcagaaatgtgagtctcagctgagagccaactgacctagaaaacatataagtgagcccaactaggatcaggagaattttccaacttaaattacaaacttgtaggcctgtgagccaatcaatgatggttgttttaggccactcatttttgtgtggtcagttatgcagcattatgtgtagcaatgtaaagctgatacaggaattagaatggaaactgataggaaagtggaatgttcacactctggccccaactctttcttttattcccataggtaaaatacactctctccctcctcccaagatccttaaaggtctcatctaatcattccatcaggctcaaggtccaggatctcaaggtgttaaacaggtcctaatgcagttccttgggtacagttgctttgagttgaagatctatgagtgaaaaagataagaaatctgaccttcaaacctaatgcaatagggtaagaaaggacagaataagtatagtagacaatcttattcaaaaagggaaagaatggaaagctagtaagaggcactggctcatagcaatcctgaattccatccctgaaaatgctgccaggaccttctcttccagaggagggaatattcttgattaggcctcggttctgcctcgtggaagtgacttcccagtccattgttttctaaggctgtgttctgtaccatctgggttgtcttttctacccccttggctactcctgtgtgctttaaacaactttcttagcctgtttccagattgtggaaattagagacctagaggttttcttacattttgaatagtctcaatatcttttagtataaactggtgatccttttgtcaatatagtaccatcaaaacttttgtgagtttcttataaatctaatgggccaaaagcaacacctacaatagttttagagctagatctctctctagattcaaccatggttatttgggcaagttaagtactgtgagacagtgctcttaaaactcctagtagcacatttgttgagcttagaggatctgctgttttctgtcctgtttctttccagggtcttaatagacggtcttaaagcaagtatttgattagatccttgtctcaggctatattttactttaagactcttttgccagctgaagagacagatgaaaagcaattttcttttccaaccaagaagtcctagttcccctatggtctctctcaatttgcttaggcactggacagttatttttctagccctttcatttcttatagaatcttaccagtatgcagcagacactttcaacattatgcctggaaatgttattgctcaaatctcaagtttattaggcacattttctaccatctgaattgacacatgtagcagttttctcatttttttgttactgcataacccatgctgtcatctttccattctcttgtagcagtttcctcataatttttctagcctctgcccattttttttttgttatagcagccccctaattctagataacagtttcaatgttagttacttgttgccacaaataatgttgcatgacaagtcaccccaaaattcagtggcttaaacaatcatttatttagctcacaagtctgcagatcaactattgaggctgcattgttcttgtctctgacatattttcttgaggaatcaactgaccatcagcagatccagatggccttggctggggccacttggctaagctgcacatatgtgtcatggctagcccagtgagctagcccaatgcattctcattagcagtgtctgagtacaagagtatgcaaacctaaccatgcaagagggcaagcacaaatgcacagaggcttctccagcttctgcagccgtctcattggccaaagcagcataaatgatcaagtccagagctggaacaggacaagattacagtgttacagagcaagaggtatggatatagatagaccattaaatagtgccgttaataacctctgtatgccatagaaattatttctgtgtaaatataagaatttctgccaggtgtggcggctaacacctgtaatcccagcactttgggaggcggagcaggcaaatcacttgagttcaggagttagagaccagcctgcccaacgtggtgaaaccccatctctactaaaaatacaaaaattagctgggcgtggtggcaggtacctgtaatcccagctactggggaggctgaggcaggggaatctcttgaacctgagaggtggaggttgcagtgaacagagattgcaccactgcactccagcctgggcaacagagtgagaccctgtctcaaaaaaaaaaaaaaattcctgagttagaaccttgtgccagtgcctctctggaacagagttcactgatgtccttgtgggttaacggtgtcagtttattttccttttccggctctttcataaatttgtttgaagtattttcaatcctcctacatttcctgccagtatcatcttttcaaagtaaattccatatgtttattacctacagggttgagtgtcaccttctgttatttgtcctaagttagtcatcctactggggaaagtgaatagctgaaagaaatagagggaggagagggaagaacctgaggggtcaaaaatgattgccaaacccagaggtatctggaggtcagtgaagttgtgaatgtgtgtaaatgtggctacatatgtatatgtttgtaccagatgtgatgtttacatgagtgtgtatacaagaatttttattagtgtgggtatgtgtggatgtgtatacatctgtgtattagtgaatgtatatgtgtgtggtaatgagtattccttcccagttcattgaaaatcactatacgtgacctgattaatcaatgagccagttacataagtactcacagagcaaagccctatgggaaaagaaggaaatatgaaatacggagtcaaaaaggttgtaagaacaaagcaggagttgggggctcttacaccccagctttaacttccaagtttgagaaattctaaatggcattaaggaccatttaactccttctctccccacttccttcctccggtctgaacatggggagatatgggataaaaacaaccacgttgccttcccataaagtaatatgaaacaaaggagcacaagatggattttatccctttgattctcccaccaaagtgtcccatctttactggagatagaggacccgggagaagatatctagtcccttctctgtctcaagagtgggatgatgttctatttcctccgaaatactttatatttgagaaaacataccaggtatgtctttgccaagactctcttccaagaggcctggtttgagttaggagcttgcctgttattcactggtttcgtgagttctcagaatctctcagtgaagcgtcaggaatctggggttctttggaagtcctaattctagttccacacagtgcacaaagctcttaagacaggtgggagattttctgttatgttgtatgaaagcatttgttgttctagagaggaatcagaaagttgattccacttgatgtattagtggtgatctctgaggggaaacacctttcaattgggaggggacggtgaagtcatgagattgaaaacttttgcttgaagaattctgtaatcctagatgacctagtactacttagtcaatggataaaattacagaattactctataagggttagtattatcccatttcaggattaaacctcaaagagattaaatcatgtgcccatgatcactgaattgggatgattccagaagaatgctcttgggcacctcactctactgcctctatggccggtgatctatcccctccagagcaaatggctatgcacttcatttaccagtcccccatggtagagcagcaatacaaaaatgggttgactaggccggggcacggtggctcacgcctgtaatcccagcactttgggaggctgaggcgggtggatcacaaggtcaggagttcgagaccagcctagccgacatagtgaaaccctgtctctactaaaaatatgaaaattagccgggccttgtggtgggcgcctgtaatcctggctactagggaggctgaggcaggagaatcgcttacacctgggaggcagaggttgcagtgagctgaggttgcaccactgcactccagcctgggcaacagagtgagacttcatctcaaaaaaaaaaaaaaaaaaaggttgactataggttagcacagtctagatttcacactgtcccccgctgtccacagtctaattgcatacaaggctcagcctacaaaaccttgtcttagatacacattgaaccaaagttccctttatctcctcaaggaacagacagtgaggtgcaaaatcctaccctgttgttgctcagccttagacagtgagaattaatctaagaattaatagtacttcatattttaaacttgatttactatgattgcaagtcttaaaaatgatgcatgatatgttgattttgatataataatgtctgtttaataaaagacccacagtaggttttcatacattgtctccacctgaagataatgtttgacttcccagaccatacttgctattctatctcaagaaatactagagaaacaaatcctcacttatgcataaacatattcaaaggcaaaagatttctttattgatgagagcctcaaattgacccatttttagccttttctctgaaaagaaaaatgttttccaaaatgagattgctaccagatgtagtgaattacatagcagtttctcagatatgaaaagcagatgaaatggaatattctggtttctgattcagtcctattcttatctacacatagctcttcttaagtgaacttgacagtgttgtgggctgatattaagatggactactttagtaaacaagaaaaagggtttcactctgtgcaatagcaaatgagctttataatagaaatttctttgtgcaggagaagatattacaactttcaacacacactaaatatatttgctaggcaaaaaatgcatttcattacatgcagtgcacttgctattgtacgttaaccacttttttgccttgtattgaagacgtaatattttctactgtaaaatgtctgcaatttatttttatgcttctgtttttcccatgaagtaaatagccctgtactgataaatgtacgttatataaaaggtgaaatgtgcagagcaaacatctcagcttgtttgggtatctgtacggtttcgtgagcaggcaagagttaaaattttggaccacagtagctaattttattaatacaaacagtctgtaattactagatttactggagtcttttactttgacagtctcggcaactataatagatgtgtatgttctctaaaataatactattgcagctacaactataatttttcctgacaatgtctctgctggcttaaaaaaaccataattaatactttatttaatctttgcatactgtatacctagttgaccatcattcaaaatggcagtagcccagagcatagtttcttcacagctgaatgtatttgaccctaattactgcttattggaaatataccaaacaagtaaaaagggagctgtaacaaagaattgaggctttaattttgtctgtgatgagagaactttgatggtcactacttatttgtctgtaagagttgcggaagtctttgcaggttagagaattacaattatcttgctaatttcagtcttacacttgaacatgtttaatggactattgatggggattatgcttgttttatatttattttatcttgtatttagaagcgtatgattgactgtcagtggtcaggataggcataggctgatagggaaagggtttgttcccttttctgggaatgatgtagtttaagtactatttttgtagaaacaaatgccttcagtctgcctggctctatgttagggggtgctttatgcatgctgtcttatttagtcatcaccctatgacataggcattaacgttcccatattatagatctgggactagcacctcggtgtggttaagggatgtgccatggccacaaggtcagtgactgttgggccgggcttgactccagtgcagcctgagtgctcgcctacacagtaggagacatttccaaacatttgaagcctgggaatgaaagaaagtctgcttgcaaatagaggaggaaattgggaggtgatggaactagagggacggtgttttagtgatctaatatgtaaacacattcactatagcttgtttaaaatgctcattttcggtgcgctacacaggacagtttcttcagctacttatgacgggcttatttaatatgcgtgtgaaccttttaccatttcaatgaaaaataagtcaagctataagattcttagagatgtgatatctctattttctcagtttatgagaagaaactgagtattatgggaaaagaggtcttatgttttggagataaaccacctattattaagtccaataaataaacacagtagccatttcctgaaaagggctacaaccccccccaacacacaaaaccccaagaaccaacctcaaagtaaaatatccccgacccttaccaagaaaaaacaacttgttgtgaatcataatttgttgcatggacatttgtttagtctcattttctatacaattactaccaacatcttctatttttttcatttcatttttaccctcaatgaaaatgaactgtttattgagttaaaaataagcttccctacactttcaaatgttgtttttgatgtggtatttaaatattttccaacactgatcaatgactttttcttactgtaataggttaaaaatacctaagccagcaagaagagttcttatacaatggaatattcttctttttttttttaaccttttttttttttttttgaggcagggtgtcactctgtcacccaggttggggtgcagtggcgtaatctcggctcactgcaacctccacctcctgggttcaagcgattttcctgcctcaccctcccgagtagctgggattacagaaatgtgccaccacacctggctaatttttgcattttagtagactattaagtatttagtagagatggggtttcgtcatgttggccaggctggtctcgaactcctgacctcaagtgatccgcccaccttagcctcccaaaattctggattacagatgtgagccaccgtgcctggcctattattcagccttaaaaagaaatgaaattctgatacatgctacagtatggatgaaccttaaaggtgttatgctgagtgaaagaaaccagacacagaagggcaaatgctgttaagattcctcttacatgagatacctagaataggtgcattcatggagatgcagggaatagaagttaccagaggttagaagggtaagaggatgaggagttattgtatagtgagtacagaattttgttggggataatgtaaaagttttgggtataaatagtgatgattggttacataatattgtgaatgcatttaatgtcacagaattgtacacttatgactggctaaattgttaagtattttaccacaataaaaaagaaaaattaaaaaataagggttctgccaaggtattacaatgaagagacacaaagttctagcctctaatgctggacctaatacctgaatagattctgattcaacaacttcagaaagttcctgtgggcgttcttctttcattaacgttgataaatatttatttaaaagtaatgttatgtcatgtcagactctgagggactagagggatgagtaagggaggtctactgcctacaggagtggaaagacagccacattaaaaaatgattaaaatccagtaaatgggctgcaatagaaatgtaatgaatagtaggggaagcccaggagaagggctcctgagggaatcagggcctcgtagaacagttgataattgatctgggtttgaagtttgaataggaattgggttattttttattttcttatttcaataatatgcagtacattctcactcacatttcccaccttggaatcttggatctaagatatttgcagtcttttcaaatattttgtaatattttccccttgggtaagtataggcagattggtccctggaggtagaaaaacatcttgatcattctctgtcctactttctaaatatttgtaagcaaaaccactttgagaaataattcaaagtaaatgagatgtgttcagtccatcaaagagcttgtaatataatagggcaaggacagctgggtggcaagtgccttcagaaagtgtgggatggctgtgcagaggcaggaggagcgacttctgctggggcacgaaggcttatttcacatttaaggttgggtagaactgtgataactagatgtgaagaagattgtttcattcaaatagatgaacaaaagaagaaaagcaagaaaaaagatgaatccttttcagggaaacagtgaaaaagcaagttagagaggccctttggggccagatcacagggatctccaaaccttcaatattctgcttattctaaggagagaaaggcgtgaagagtcttcacccctctaccaatgtgaaaggatggtggagaataaaggagaataaaaagggatccaaaggcactggatggcattgggctcacaggtggatggaatgggtcgaactattaatagaagtatgaccagtgaaaaggagaatatgttttggagccagttagctttaggttcaaatcctgattcaaaagttactaactgcaaagttggacaaattacttaaaacttctgagcctcgttatccttgtgtgacaaatggggatgataatattatcttcatatagagttatcaggaggattaaagaggatggggtgacagatatacgtagtctccagaccactctcataggcacagatgttagttccttccccaggtgatctccaaagtcccatctaaacttgagagtctgtgaaataatttagaggatttaaaaaaatccaaagataaatgattcacataattgaagttaaaatatataaccaacatatttctagacaagtaacagaattcatttcaagtataaataaaaaatttacagccaaaacagatttttctagtgcagcagcttatctccagcaatgactctaatgtttttggaagctgaattaaccatttcactcccccaagttgccccgtagggctcatatccacgtgtttggaaatgatatcttcttgtcagatctaatatgaggtccctcagctttgtgtgagcacagagctcagagttgggggtttaccctgtgcaggatgtctttctgctaatgtgactgccagtaatacttgaaagtatcaatgcatgtttgaggatatccaccatgctttccattagaaatagcacaggctgtggtaccttcccctgtatccttactagacttcatgactttatagaactagccactttactgaattcttttttccttgttgtttttcacgtgaactgcttaggttttctattttacaatactagcatcatctgtaaatgatgtcttctcctttctgactgttgtgtctttatttgtgtctcttgatttggatataaatctgtcaggatgatggtggtagcaggcatggactgatggtaagggaaggtgtgtagggtttaatatgatatggacatatagtttgaatgccatagcacctgtcatatctttcttgttaccagaatcacatcatatagaaatttttgggaaaatgcctttttcttttttcttttctttctttcttttttttttttttttaagacggagtcttggctctgtcacccaggctggagtgcagtggcgcaatctcagttcactgcaacctccacctcctggattcaagtgattctcctgccctagtagctgggactacaggtgcctgccaccacgcccagctactttttttttttttttgtatttttaatagagatggggtttcaccatgctggccaggctggtctcgaactcctgacctcaagtgatctgcccgcctcgacctcccaaagtgctgggattacaggcatgagccaccgcgctgggccgaaaatgtctttttcacactgaactctgagcacattaaggagagggtcttttcttacttacctttatattcatagtgttagccctgagcctgaacaaaacacttgtgtagatatttatgggaggtatgagtaaatatcttaatttattagagatcagtaaaggtacttatcaataaaggtatcaataaaggacaaaaagtccaataagaaattatgaatatcttttcataatatcagagaacattaactgtttagctgtcttcctaaaaaatgtttcaattacaattaaggatgcttgtcttttttgtgattcttatgtaggatagcaggaaggggacaaaattttaagtcatatcccatttgttattaaaataaagaggggaagcccaaattctatctaaattgttggtccaagtgtggatcccttaatttcctttctaatgtgttttccagtaaacatacagatacataaatgcaagagttaataagattaatgggctactttgtatctgcccaggaggacacaaaacaaggtaaaatttattatttgtggatgctatgtcatactatttttaaaaatctactctaacactgtatattaatgctgtataatctcctttcttggtaatttccactccacaatttttatatattcctatttgaaataatgttttatctcttaatgtcactcatttattttatcatttttaaacaataggatatgagatgggactgaataatgagaaaaagatttcttaagggagaaataaaatatatcaaagaataatttgtaaaaccaatatggtagaagtcatatttattgaaaaaaattaatatctttgctataaaatttgtaacaggaatatttactgaatgtttattttgatgcataaacctgaatgttacataccaagtacaagacaataacactagtttttcctttatttacactttatgaaaactgttatgcagtccatgttaaaagaacttatgatggagaattgttacattagaaaaataatattcttgataaagcattctcaatgtgtccaatcatattttctgcctcttcaataaggcaaaagtccctggaacagcatataacttaatttacaaaatacaataactgtttagacacatattcaagttttcttttggtatgcttttccctcactgtaaaactttttcttttttctttttttctttttctttttctttttttttttttttttttttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatattctcatggaaaagacttcatatgacacattcaatattcctgggcctataatacaaaactttagttaaatagaggcagttctgaaaattgaaatacattgtattctaaaatttttgggaattgttttgaaatctgaatgcattttctgatacacaccatattagatggatggttaaattcccaggtcaaccgacaaaagcctatgagacagattatgtgaaggttcataataactttgagaagtaagttttctttcagtcaccaccagtgttctcatttcattctcacagcactctggtgagattcgtgagcagatattaagatgcatctccattttatagttcagaaaacggtgtgagctacagagggttaagtgttttatcaaagacacaacttgggaaagaacccaagggttctttcatgggttggggcctgggccttgattggtgtgccttaagcacttcccatgattgtcaacagccaggggtgaacaaccaggggtgctgggaggtctttctcagtagcggtcacctggaggcacttgttaaaaaaatcagatcccccagccagcctcttctctggagatccggattcagctggtcttgggtgtagcccacataatctatttttaacaaccatcccagatcattcttatagtcaggcatatttgggttaagaatggggacttaggccgggcgttgtagctcatgcctgtaatcccagcatttggggaggccgaggtgggtggatcatgaggtcaggagatcgaggccatcttggctaacatggtaaaaccctgtctctactaaaaatacaaaaaattagccgggtgtggtggcgcgtgcctgtaatcccagctactcaggaggccaagaggcagaagaatcgcttgaacctgggaggcggaggttgcagtaagccgagatggcaccaccgcactccatcctgggggacagagagagactccgtctcaaaaaaaaatggggacttaagccagacaagcttggattttactctggctaggcctcaagctgtgtgactttgggaagattacttaacatttgtaattctcagtttcttcaggtgtgtaatagaagtcatatctctcagggtattgtaaggattatatgtaaaatgtaacacagtgcctggcacaagttctctctccttatgtagacatgtatatgtgtgtgtgtatggaatattgatagaaaatgacactattatctaaccttttgtagtacggagtggtatgtggtcaaaactagtttttcataggtccaggaggcagctttttttaagcctcatgagaccaagttatcttctcaaagagttcccttctttcttttggaggaggacagcacagatcatctatggtgggctctagtctccagtcaaattcaagtgccacccctggcatgtccttccccagatcaaggagaggccatagcggaacacacaggccgaggtgcctgccagcccaccagcaccttgtttacagtgtaaccgccacctcccttggaaatgtagggaagaaggtttgtgccattcattagggaggggataaaaagctaagtttttgagggtaaaataaatatctgatttaaatataacgtgtaggaggccagctggggtcagaaggggcagtgccacccagcagccctgcagctggctgtaaaaagtgtgacaacttacaatcaccaggaaacttttccttgccaaactcttctgaaaacactatttaattctcaccacactctcataagatagggaataatttaccaataagaaaactgaggccctgagagactcagtaaatcccacagggtaacacaggcagtaagtgtggaccagacctcctggctgtggtgccttgttcttaaccacccctgcccacctccaccagggagaggaccatggagtaaggacaggaaataatcctcttggtcactgcctctctggccctgggtgggtgtggatgccatggcaggcatctgtgtacaggagggcagggctcctctgtgatgaatactattagagtgatagcaacatcaacagcaaaaaactgaaaattcccaactcacctggctcacacacgttcatattgctgatgctcgggcacccccacattaaccatccatcaaaacggtaagcaaatcatgggaagtcttggctagcatgtactgaaatgtggcaacatcttgttttccatggtgtcttttgacctgagcctagactttaaccacaaaggaagcaggacaaggcttgcagcgggacagaggtagctaccatttaccgagtcttcactgtggggcagggaagagtaaattcttcaccagcattatctcatcagaaagctcattaaacaagcaagtgcccccctcacttgctggagtaaagaaaaggagacacaaaagatttggatcacagtgatagaacaatcagtaacctcttccagtttagtagttaagtaaccagtcacttaacttctttgggcctgtcttctcatttccaagacaagggaattggaaagaaacacagggaatgccctgaggacttggtttgtgtgctggcctctccatatcctagctctagccttaggacaagccattcaaaatttatctgtcaattaggttgtggcaaagatcttaaaatgagaggatgtgataggtcttttgcgcaccttaaagcacaaaacaaatgacggtccccactttagtagcacttattgtgtgccaggtactgttctggaatgcttttcatctactaagtcatttaatatcaaggataaccccccaaaaaccactttacagatggtggaacttaggcacagagatgttaaataagctgtccaaggtcaaacagctaagaagtgatgaaactgggatttgaaatcctcgtaattacttaatacatacttcagattttgagaaagccagaaattagtgtaatgggaattaatctcaaatgtattagctgtagtttctgttggtagtgtaagatataacagctgggttctgccacaaagatgcaaataatacagagttgtgtcataattatggaacagaccacttcaaataaaaatctatctaaaatatccatttaataaggctctcagcagctgggcatggtggctcacacttataatcccagcactttgggaggctaaggtgagaggatcacttgagcccaggagtttgagaccagcctgggcaacatagagagacccaatctctacaaaacatacaaaaattagccgatatggtggcatgtccctgtggtcccagctactcaggagactgaggcaagaggattccttgagcacaggggttggagcctgcagtgagctgtgattgctccactgcactccagcttgggtgacagagtgagaccctgacacaagaaaaaaagggatctcagctaattctagaagaattccttaaagttgtttaaagatatttatatctcatgacagaagaaagatcagggagaaagctgtatcaggtaagttagttttatgattttcaaacttttcccctaccctgacaaaataacctttatgatattttatcttttgggatttttaagacaaattcaagagaaaattcaatttgtcctttgttttctccctatggccaaagaatttttactttataaatacttccacttacttcagttctgttctcttcctaataatttgtcagctattatcatcttgccatcacaatatcctttgccttcccaccagtacattctttgtctagagaattgagactctggagtcattacttaaaccaagcacccagacctcactggctgagctctgagtgaagtttacccctttcctcatctcctgcacgattttcttccctgaatcacttctgagaccagggattctctctaagctcctacttctgttcacacatggagccctgggttcctgggaagagctgttgcttgcccagcaggtaagtgaaggggtagaacttggagcaaggattatgaatccagcccggctttcagagtgacgcattccctcactcccaagcatattatgaggagatgattgcaatacacgtggttaagggagcactgtgtagcactgtgatatagattagagatagatgccatgactatgaaatcttttccccatacaccatgtatttggtgctctagcaagtggagaggatagtcataaccctgaagttttgattaccctcttacccaggtggcttttgttccaagaaatttgtggcctatatattttcaatctttgatattgtcagtggattcttctacctgttttgtttgaaactttcttaaatttattcttttaggaaggatttatttgctacaaatacaaaaaagaaagaaagcaaacatcagaaggaaacaggctgtgtgtaactaaggagcttgtgtgctgttgataccgcagaggtcatttataaaatctgcttgatttattttttaatttgctcactctaggccaagcctactgcctccttgcccggcctctaatcacatgtacaaatggacacaagcagatgcaaatcaatttgttctcatcatggttggctccataccccgtatcatcaggcaagggaagcctggtgaagaggggctcctgtttgggctactgaaaagacgccggcagaggccggagcgtcagggaagccagttgaaaaccagacttccttccatgggcaaaactgacttctagcctttaaatgcacatttaaatcttgttcattcttcacatcctgggcagggcacagtgttagcacacacagacacctcacaacaaatgttcacagagagaaatacaaaatgtagatggggcaaagggaggggaggaaggaagggagaaagaaggaaaagaggaaagaagacaagaagtcaggaattcgaaggagtgaagcaagaaactggtagaggaagggaaggaggcagaaaaaatgtgatgaaagaaggtaaacaggagagaattaaaaggagaaaagaatatggaaggaaaatgagggcaggaaggagagaagaaagggtgggtagaaagaggagaaaggaaagaaatgtggcaatgttggctaaagcatcccagagggaagccaccagaagaagcatggactcgagggtaccttgctgttaatcatgactcacagatttcacccttctctaactcctagttcagagagtatcttccctacccaatttagcacttcattagttcatgtctgagtctcaaatcatttcataactaggctacaagcttgttgagaatagggttctatcttaggtttcttttgtgccttggtcatctcctgttcttctctggtccctaagacagtgctgggtacatgaaaagcagtgaattatcccagcattcattaggtccctggtaaccttaccaacttctctcactgtggtgcacagccttttttttgttctttatgtagtcaagtggggagtattgttatctctgctgtcatatgctttccagaagtgctgtaatatctaaaaaacccattcattatagtctgtctaaaggatcactcattgatattactgtgacaggctgctcttaaggagaaccccagaatatgcatactattaaggatcattcaggtgggcaatctcataaacactactgagagcatttccccaccctcatcacctggttatagtctgggaaagaatgctatccaattaattaaacaggatctgaatctcctttccatagccaagacatttaaattttgtgtttgcagaggtatgctattagtacagaagtgcgaatgattctcccctctgtgggaaatgtaacacatgcccatgacctctcaagctggtcacagtggtgtcgtgccaaaatagcaggtccttctatatcctccagcctctgtggccacattacgctgagtctggttttcagaaccaaatcttccacaccatgggccttgggaagaggctgcaggtgtgtagagggggcaaccagacacgcttggaaaactgagccttcatctcctaaaggatatataaacagggaagagcagacgaaccctcctcttgactgtaagaagtattcatctgctaatgctcaagtcaaatgtttcttctgggctgcttcggagagacaagaggttgggcttgatgggccctggggctgacatgggagattctatgtactgatagaaaccattttcatcatagtgctgcctattttaaagagtttgcctgctgtgctctgggcatgatttttgactcagcaaagcttcagaagccatggctgcccccaacccggaccctgttttcctctgaatgaatcttcctttttcaagtgtttctgatacaagagaaccgggtgaatgagagtgggtaatttagaaaaggccaagaagagaaaaatatgcaaatatgcaaatatcaacagcaggaataatatttaactggaaaatagcttattattgggctacatggttttaggaagccatgtgcaatgtacatgcccggcataatttaaattaattccttccattcctagtcattcttacacccatatgtagcctttggggaaatcctgaccacaacagtgacattacaggactgggtggagcctgctttccctgttctcatcagtacagggtgggcactggattttgctctctggattaaaaagtctaaatatcctctcagcctcactggaatagaaagcatgtggtctgatccctggtgcccagcagttttagagtactttttcaatatactttctaccccaggcatgagaaggaacctgacagctctgtgggcgtttcattcagaagatggagagctatctgggagtaggcaggggacacctcgtgtgtttcctctgtgagggaaatactttcttcatcactctaaaataaaagtaccagtctgcgatgagatacaattcctttgactgaatcccatccagaaaggcccatcatctaatggccagggacaaggcatgtgaattctctctcctcagagactggtaagggaacgtcacaaatcttacctgagccctgaggataagaatagaacaagagcttctacccgccaccccctccccgccagccaaaacaaatcaattcattacttatcaatccctgcccattcccaggagatgattttacacacacacacacacacacacacgcaggcacacacacttcactggtgatcatcatagattctcagcctgcgatgatggagtggaggaaacaaagtgtcctgaaattctttgataaacgacaagtggattgttggccattttagctcctactaaaacaacagctgcttctcaacaaaggcttctcacttgggacttgcagaaagggagaacagaaatgtcaacagtacaagggaaggatggtagcaacaataggaatcatttcttgaggggttattctttgccaaacacattggtgcaagcagtgttttgtttaatcctccaggcaaaggtggtggtgatattaaggaacaataataccagtaaaggggaaacaacagcagagaaatccttcaaatctatatgacaacaaaggaacattgtgcagcaagtccttcttatttcatctgagtttaacatgaatgctttctctttcttacctgtgcatgtgaggggaaaccacaatgaaaaaaatagatgattctgaacctctagaattttaaaattctctaactcctttcaccctgttttgttctaccctgtcatgaaaggcatgaaatctgtatgactgaaaagattcctctcaaaggggaagtgttagatccatttaagaggttaaacagttttgggatcatgtattgggaagattatttgaatcaaaataagaacacatgatagtcatttgatgcatgctagccattgaaaatttagcatgatttagctgtgtctgttcagggacacagcactgcagtctgctggtctggtcgtaccaatcccatgcgttttgctgtgctctatggaggaccttcttacttatttccattttccttcatgaccagaaatttgacaggcaactcgctggcttctctagcttctctgttttgcttctgtgtccaccccgctcctgggcttccctagtgttggttaatgatgttgttttattttgtcagggccccttccattgttcacatgaatttgacacataaatcacattctttttgtctcttctctatgggtacacaaatactgcggtggggtaggagtacagctaatttgtggatgggaaaaaccgagcttcagggaggtgaggaatgatgtctggctctggatgtgagcctggaggggcacagctgagaagaattttgcagccacttttttctacttagagaacaacgctggaaaacagccattaatacagctttcttgagtcatatcagatctttatattatttgggatgatttttcctcaattgtgtgaagtccagaacatggaatcctataagaatatggtctgaggataatgccctattagccacactcacctgatttcacccttattttgggaactttcaggtgaacctatatttttaaatctctcataagctttccaaattaacttggcatctgctaaaagtcattgtcattttagataactgctcttctttttacaaagacaaaagcaagcaaaaagaggagaacaagctgccaaaaactgaggtccttgcaaaagagaagggctgatcaacccccataggctgctacagccctagttcagttcatgcagagtccacctgcaggcagcaatcaacatgctaaatttgagcaacgaaagttcactcgagcaaaataatttaccttggagtccagctgctgcatgtatgaccaaagatattctatgttggctccaaaaggatggacgtgaagaaacgttgatatgatacctgaattaaaaaggcaaacattggaaattattcaaaggcatatgagagtctctggttaaataatgctgtctaatcccagtgactattttgtcaggctgagttatggtcttgccatttctagcagcactcaacaagcattcaataatagcacattctgaaggcagtaagagtaacatggcaaacagaacactttatctcctggaatgatagtagttagcaaagctagactctgagataatatacagctgaataaagatatttcaaaacaaagactcctggaagcatttcaactaccaattttatgcttgatttaccaatataaaattatagttattggaaggataaaattatcttttctttccctcagtggactttgcagtatgaaaatggctcatacaactgtgtcagaaatcacactgcctcagattttcctgataattacaattgctagatatgaaaagtatttaatctatatttcccccaactgccattgaaggaagcccaaattcttcctgaaacatttgctgttctctctggttgtcgctcttgtttaaaaggagccagctcattctccccttcttgctgctgtaatttacaagatcattttaaaaggtctgggaatggatggtttggctgcagtttgattataaattataaggctcttccatcgtgcaaatcagctgtcaacattgtactgacaaatgaaaagctggacgttgaagtcaggaatgaagtaaaaagcattaccttcctcttctccctgctcctggatccaaaatcaaaatagtgaacatgaggaagtcaactccaaaaactgtagactgctttttgttaagaagttgtgcacttgttattcacgatagcaaaaacatggaatcagctcaggtgcccatcagtggtggattgcataaagaaaacgtggtatgaaccatggaatactatgtagccataaaaaagaaggaaatgatgccctttgcagcaacattgatgcacctggaggccattatcctaagtgaactaatgcagaaataaaaccaaatattgcatgttcttataagtgggagcttaacagtgggtactcatggacataagaaggagaacagtagacactggggactgctagaggcgggagagagggatgagggaaagggctgagaatctccctattagggattatgcccattaccagggggatgggttcagtcataccccaaacctcagagtcatgcaataggcctctgtaacaatcctgcacgtgtacccctggattctaaaataaacgttgaaaaagaaacaaaagaaaagttgtcctcagactgatagttttagctttctgttaaaaaagtttcaagatgaattaaatctgagggtaagccttcatgttctgttttttgtgagccttcatgcttgggagccagggaagaccctcacctgtatgaaatgccatctgggtgggcacaggtgcacacagcattcttgtactaggtcatcctataggtgaccttggattgatctgccatagggtttcatggctccctgatgctatgggatgagtgtcaagtttttaaagaaaagttcccagttcatcctcaggctgagaacagaaaaccaaagggactctccaagacctatcctcagaatgttgctttcccagggcttctagaggatgacagtgagatggggaggtagaaacaattcccacatttccctgtaaaggtagaatctcagtttttaaagactgacctgttcttcctgagatacaaagaactaccacttcattctgaggttatattcttccttttttcttgtcaaaatgtccttttttgaaataatggcaatggtagaaggcaatgatgatactttaaaaatatctttaagtggaaaaatagccacttttaatgtactcagggagcattgtgttgtcccctccccttatttatttacttatattttaattttagagacctgacagctacttccctgtaactgaaattctcaattctggtgaagtggcattctaagtaattctattactaataagagttaaaatataaaagctcaggagtgatttctttaaaaaaattagaatatagtagaactatttaaaaatgattattttcatttgcatttccttttttgttttacaaagttttaaattgatatataatatttgtacatattttttgggtacctggcatattttgatacctgtatacaatgtgtaatgataagaatcagggtaatttgcatggccatcacctcagacgtttatcatttctttgtgttgagaacatcccaaatcttttcttctagctattctgaagtatacagtaaattactgttaactataatttccctactgtactatcaaatactggaacttagtccttctatttgttgaatgagagagtaagggctgaatcacagttcgtgtagagggaatcccctgtttcacgatggtgagtggggctttcactgaccatcccaggtactatggccactgctttccacagagagcctcccacaagtgatgggcaggagaaggacaggggagggagaaggaagagtcagctttggctttgtgagcaggtgagggggtgctcctagtcggaagctttttttctcctcctcccctgcagggttctcccagggaggtgagggctgctgcaaggtggggagcagcattcctcgggtggacatctgcttacgcagcagggctgagacagggagtggcagcagcactgcagactttggggtgacaagggtgtataagtctcccatggagaaagagggcataagacttgagcagtcttaagtaaactaccccaggcaaataaataacaatatttttcatatttaatattccccctggccagagagccttcaacatctcctgcataacctacagccttttgtaaatgtccataggtgtatggttatcaacataaatgtctttaataggatgaatagaacaagtcagaggaggatggggtgggttgggggagaggttgataacccttagcctaggagacgaagtgttgacatgggtcatttagggacaccagaaatgggaggacctagagtgcctctgtgaagttggcaccctctgtgaacatggatttgctcctccactgtctactacctttcaaccctaatcctgggtctgcaccccaaggagctgtgctcttagtctttgtgtgttctggttccatatccagaacatagtacacattcataagaggtatatgttgaacgtatttatttgccagaactggaaatctccagtatacttgtttaaaaattctattagtctattattgataaatgggaataaataagaaccttaaacatttctacaagtagtaacagatctttcaaaaaccaggtaactttgagatattattcactgaaaattcttactcttaacccgtcctgtcatggatttagaaggatggagtaacttggatgttttgagcaaggaaaattttcattgaaactattttgctcataactaaggggaaaatcagattctaaaatcagattagaagtcctgacgtggacttgagtgttcttttaggagggtattcagaaccatctctgtggtagctgatattaagaagccattagcttttccttataagagttcagcaattgccactagatatatgtagggccaaggcaggcagtcacaaataggcttcccaagcttttcctgtggatgacaacccaattatccagtgttgctagagacacagccgaaaggaaagcatgagtcatcatcctccccggtaccttgcctctcctcagcccacctcccactcctgcatctgtccatccctgtagcaccacagaagcatcagtcatgccacttgagaaaatgtttctaggccctgtgattttggatcaggttcatttgagggaatctttctaaataaacaagtaaagcctctttgcagcttttttttttttttttttttttttttaaaggaactgggacattccctggggatggaaaaaggatggctgtaactcaaaagttaatgaaaaatgccacaaacctggaatatggagactattttatggtcctctggaatagacctaaaggcttggtaaaatgaacactaggaatggagggtggtggatttagctgttactgaactggtggatctccaaggggatggctcaacaattggacttgcttgtttccatggagatgtagaaggcctccatattggagaatgggtttccaaaagtggaaaaaaaattttaagtgcctaatttaaaaaaattttaaaagaacaaaggaggttcagtaccattgggctttttgcacatctcagaatcttaaaaactactttagaaagagtaactagctctagaggcctgtgccaaacctcgttaggaaggtccatttaaattggctacccaaaagcactctgagcttctcccatcaaaaccatctagtttatttacattattgggtctcactaagactaaggatgcagtatttaaattaaccaaatagtgccagatttgtactgcttcatcacttattttaatacttgaaacacttagcagccaggaggtggcaaggtgctagaggcacagcattgtataagataggcaaggggctggtcctgtggaacttttattccaggtgagcaacacagataataaacacaaagatgaaaaataaaaatttttagatagtgcttagcacaatgaagaaaacacatcagggaagaggacagaagagacagcaacctgcagtttgctggaacgctaccttacacaaagcgattgatgtggtttggctatgtccccccaacaaatctcattgaattatagctcccataattcccacatgttgtgggagggacccagtgggagataactgaatcataggggcagtttccccatactgttctcatgctagtgaataagtctcgtgagatctgatggttttataaggggaaacttctttcacttggttcttctctcttgtttgctgccatgtaagacatgccttttgccttccaccttctgccatgattgtgaggcctccccagccctgtggaactgtaagtccattaaacctctttttctttataaaacacccagttttggatatgtctttatcagcagcatgggaatggactaatacagcgattacgtgaagccctctccctgagaaagcagaccttctcaagtgtgagatgagaaggagtcagccatggaaagcccgggggagaccattccaggtacaggccacatacagtgcaaaggccctgaggtggaagtgagctggcagaacacactgggctggagagtggcacatgtgtttagaggtaggtgggggccagatcacgcaggaccttgtgtgccaggggaaagagtttggattagatttaaattctaaatgtggcaggaaaccaaaagagtggttctaagcaggtgcttgacatgatctgaattatgttttaaaaacttccctcaagctgctgtatggagggtagagcagagggggaactgggaggccagttggaagtgtttgcatgagactggagtggtgagtcatgatctggactgcaaagggagaagcggactccaaagggagagccagggggctggtgtgagcagtgaggctggggaagaatgaaagatgagtaaacagtttttcacttgagcaactgggtgggactattttctcagatgagaatattggggaaggagcacattagggcaggaaaaaggggaatcgggagttctgttttgtcctcattaaatttgagatgtgcattagcatctaagtgaagaatattaaatggcagctggagatggtatacatttgcaatggcaacaaaaagggatttgaagccaaagtattcattgagattacctaggtagagaagaggcctcaagactgaaggctggagaagcccaaaatttagaggtaagctgaggaaaactcatcagaggactctgagagggtttaatcaataagaaagtgtggcatcatgatggcggagagaagtatttccagatgtgagtagtcaaccacgtaaagtagctgccaggtagagggagttgagaaattggtgacataaaattctctggtgatgtggaaaagaatggttttggtgtgaggatgcaagtcagactggaggaggctggagagagaggggaggagggaatggtgactgtgagcatagtgcgttggaggaatcctgctttggacaggggcaggaaatggactgttgctggaaaggggtcatggtgtcaagacagattttccttctcgtttgttgcaaaggtacaagatagtagagttcatgtttatatattgatgcacatgatgctccacttacatacaagatcactaaggggtaatgcagctttcataatagtcctcatacattacagagaattgagttgaaaaggaccatctaatcaaacttcctaattttatgcagtatgagggcttacacacttaccacagtggtttggataagtgatttgccttagattacccggtggatgaaatgcctcaatccacaaatatttaggaccactccccctcccccaccgctcagggctgcttagagatcattaggtattatggtttctcctttgcatccttatacaaaagatgggagtgggatgggttagccctgttatagtttaattatattggttacccgatgagaataaactatcactttgtgcattcagtttggtcagcacattattctctttgagtggaatgagaaatggaatattgccagaatatactccccactacccccaggctgcttggagttttcattccaaactctctgtgtcaggttctaaagttctggctgagatttgctttctctacacctacactggttgatagtctcctaggaagcttcaaaagaccctggggcccatcagctcactgggatagaggagcaccttggggctttccagagaccttggctctgcagatgaacagctgtgtctctagacacagtcacatcttgctgggaattaccagaggcctgaccataaaccagcctgaaatagtcttgtttcatgttgacacccatataaatggtccacggatgttggagaatcagcaggaaaaaaagccatgcaaaatctgggtctcctagtaagccctgaggggacagttgtctgtgggcagctgcagagtgatgaagcgtatatgggaagtggagagaaactgtaggaaaccgatcaaacacttgtggtttgggctgatgcttctcagtgccttgggattccaaaaagctttaattttccaaaaaagtttattccgcttacttggtgagtacaaaacctaatcttgtatggttggttagttagttttgtgttgtaatatttgtctgtcttattttttcgattaaacccctcagactgtatttgaacctcttagtagtaaattgttcctggtacctgaaatgcccttaacaacttctttatccatccagtgaaaacctcttcatcctttaggactagctcagctgtcctttcttctgacaaggcatctgtagcataagtagctccttctctgtgtctctgattttactacgaaccacagttcattgtaattaactgcattctttctcattatctatgaacttcttgaggggagatcatctttccaccatcagttaatgcatgggatagcataaatcaggccagcgtttctcaaaacatagtaccagatatgcctgctttagcatcctctcagatattagtattgcaatgaacaggatcactttcttttttttcttttttgacagggtctcactctatcacccaggcagttgtgcagtggtgctgctcacagctcactgcagcctgatgctcgtgggctcaagagatccttccacctcagccccccaagtagttgggactacaggtgcatgccaccatgcccagctaacttttttttttttttttttttgtagagatgggagtctcactatattgcctaggctggtcttgaactcctgagctcaagtgatcctcctgccttggcctcccaaggtgctaggattataggcgtgagccaccacacctgtgtgtggggctaaagattctgccttataaataggctgcctagataattcttttccacaatgaagacggattattcttatcgtaggctcttgataaatgtttgttgatttattgatatggacatttgtgccttggaaacaagatttaggtcaatgactcattctttatggtcagtagttttcagagaggaacatactcccaagattacttttctcaggtacagcctaaatatagcctcaactttattcactgaaatcaccaaaaattattgcttaaccttctttaaaaatatttttccatattctactcagctgtttctttatacccacattaggaggagccttctgcttctggtatagtctggttttgtgcacgtgtgagatggtgactgtgatggaaatgatgtgtatgtcctgatctgcagaggactcaggatatgtaagaaagtttgcccaatcattgtcaacctgaggacagttctcaggggaccagggaggttttagagaaaagctgctttgttacagttaaaagttgtggagaagtttttgactacatctggatagtatttacaatgactagcatcaacagggcgtcaatcagagctgctgggattgaaatctattgtgttggaattattataaaaagcaagagaatatagagtgatacggacccagagagttatactctcagctctctgcagaactattagcttgtcaataaaaaaaatttgatccatttttcctttataacaatatccagccaaacacagctcccaaactttggccccaaatcaaaagtaatgactcattctatcccaaacaacttcagtgtatgccaatccaacatgcaggccatatgtgaaataaactagttctggcatagacattgagcaatgtcaagctgaccttatgtgtggttactatagcattatgaaacaaaatgctaccctgcaatgcccccataaaaacagaattctctaaggtccaattatatgtcaacctgtctccacaaaaattgattacaaaatgaataacccagaaatcacaaaaataaagtattttccaggggcctgtcttctttagttgaattggaagacccattaattgtcaagaagaaagtccatcagaatggtcgaactctaataatactcaggatccagatctgcaaaattccaaattatgtcaatgaaatcccacggatcctctctaataaatatcaactttatgccttgaaataaagactctagttttatacaatagtcataagaatgtctgggcagaatacacccttttgcccagataaatcagtgtcacaaataattatatgtaactagaattgctcattgtttaggaagttctagcctcagttttattctttctgtagatggaatccatttgaagagcttttttctcactccctttctcttccagggaatgctttctgccagtgtgcgtttcttatataacatttatgtgccccaagagggcactgatcatctgactatattggcatacagcatacactataagcatgcagatatgatgaagattttgccaattaatgtttccaagttgtgggagattttctgctgtgtccttggccttctaggctggcctagagcatgacttttgtgtcctctctactgacttaattattccaagggaagatttcagggggaattgcaaagagtatttatgactgctccagatgtaccagaaggccagagggctcctagaatcattcagtgcatgagaattcttcagaaaagtgtagccccagcaccaggaaatcctttttctctattctgatccagagcagttttgtccctaccacagtctgtatctagattccagaagcttcaggggagctctttatggacgcaagattcaggtatctacaaagtatgaatgaccaaactcaatgagtagataggatcatttagtggcaggcagaaactgcagcttttggcaggatccattttgctggtcttggaaactctttcccattgtggcattcttttggaggattatcctcttttggaggattatacaaaagagtagaagtatatagatgttttggaagtgggtttggcaaggaaatcacatctgttgccaaactgtcattaagaataataaaataaaatattgagaaaggtagcaaggtaatggataactgaagggaaagttaaactcctaagtttattttaatcacttaagtctctggcctcccttctacctaaatgttctcatatattgattcaaaataagtgtcaccccctgtttctcttttgctctactcctaacttcaaatgctaatattagtaaactagttcaaaagaccaacagtgaggggaaaagtcttggaaaatttagaattggttgtatatgctttttattggagatcctgactaatatttttctttctaacacacttgatttaactaattttatatagttttttgtgataccaaagacatcagcaggcatagcatgttataaatgtaatcttcctacctactcccattaatgtactgcatataaagcacatcatttaaaaatatttgaagtagccaactgaaaaaagtacatgtatgtgtatacatatataaataaaacctaataactacttagaaaacattttaaatgaactgtgttctccaattaaaacataaaagaagcagctatctctagtgaaaggaaggaaataaaaaaatagagactggttcccatttttttaaccttcaagtggacagaattcttcctacttaaagagggaaaagtttactgcagatcattaattgctttgttcataccctaaaagcattatagggaaaaatcacaccttggtcacactgagtgacagagaaacagttgtcagacttggacatgttttccaatagaagaaaaatccagttaccaactacatatgggttcgttttgggttcctggaactgatagcacatcagcatgtcttctgagactcatgcatggcatgttattacagctgtatatcatcagagcaaaaaaaaaataattggttttcctgggagtatctctaagttgatgtcatattcaataaccctgtagttgaaaaatctatatatgatggatggactctggactgtcttttgaatttaattcctcatgtgccagcttctctaggtcctgttgtacctgtcatttttaggtgagcacatgcagtatttacaaaatgcacccagggaccaggcgcggtggctcatgcctgtaatcccagcactttgagaggccaaggcaggtggatcacctgaggtcaggagtttgagaccagcctggccaacatggcaaaaccccatctctactaaaaatacaaaattagctgggcgtggtggtgtgcacctgtaatcccagccactagagaggctgaggcaggagaatcacttgaacccggcagaaggaggttgcagtgagccgagattgtgccattgcactccagcctgggcaacagagtgagaccctgtctcaaaaaaaaaaaaaaaaaaatgcaaccaggcactatttctgccagataatgaactgctgaagaacagtttgtcttgcatgtacattggcctcattcttcagtcttaaccatgccaccatggagccagtctcacctggcaaccccacactggggtcagtgccaaggtgcagcttgaatcagttctgtgcatcacagcatgagggtggtggcttcccttcctctgaatttgagggcttcaaagacagccttaaacatacaggcatctaagatgggcttccatgcacactgccggcacatcctcatcaagaattcttcctcgtgaaaataagtaagacatctggatccactgaggatgcttcttttgttcatcctggacaaaaggatccatacttggacagggaagcctgaagccgattgtcctggattagcctagcatcagtaccctgcatggccctatttgtcagcattgcaggtctagccttgggagtgactttaggatgtggcctctgctaaggggcttagagtttaatctcagggttcaaagctgctcttgagcctggggatatggcttggtttggaactagatgcaacctggcctccagttggaagtgacatgcccaagctttgaaattcagatttgtaacatgtgagatgcaacttagcgtattcttgaactcagtttcatgtctgacaatcagttaatatatacagttacagaaaggcaaaacccccattagtttgtatgccactaatttgaaatgtatgtaatataatcttgatgaaattaatctcaccttttaccagaaggcaatgctgtttaaattaataagttaataactaaaatattaagttaattacctaataattatttaagagaacagatgaagaaaacagaatttccttacctattagcagagcttctttctctgattttaagccttggcttcttttctcaatattgttctctcggtcttggttgactaatgcaactgtcaacacattgatttcctataaagttaaaagccaaaaaccatatatgggtttatgtagattctgtgcatgtcaataaaaaacaccagatctcttaaactctataaataaggtcatcacttctatttataactaaagatcaaatcttttatacaattgatctatttgcccaagagtagaaaagtaattatgtaaagttaggctcctaggtactgctccccgcataccaagtaattctctgcacaagtggcaaatttggcacaagttatcttagatttttgtccatgttttcattaaactctgttcattaaaactgtgtttgattatagctactttaacatgttttatttcaaagatgaataatctttgggaaagcatacaggaaactgatttataataccatgctaaaaatttctgagtgtgtggagaaatagggcctattggggagctaagatagaattgttagaagtgtttttaaattgagtaggtatggatcctcatgaataaatgcaagaggcagataaagcaaagcttggtaaattcttttttttgaaaactaaaaatgaagagttgtacaacaagccaataacacgtgaaacattgaggctggactatttttagttctttctgtagtcttttacatttaaaaacagagatgaagatttaactcatatcatcctagacttttgatattaggactcaaaatggagagtgatttaatggaaagtcaaattaatgatctgcatagatgacctgcatatatgggatagtagaatcattagggaagttgagtcttactggaggaaagttgctcactgaaagatggctccaaagaaggactagtatatgagcagtggtggggaacctgcagggatgatagagaacaggtacggagagccgaatggacgaagaattcagaaggtttgaacaaatgtgttgacaggtgtccctagaactggaagtggttataggagagatatttagatagttagtacaaagtaacaaaactggtcagatccaagagtacaggaagtattgggagcatgccgagcctgcaaaaagtgaaaaccacacccgaaggcattcaaagaaaaataaacccagcacatgccatcaaaacagatctttgagcttaatttaacttatgagctaccactttgtaatccaggggtaattagaaattgccatgaaagaaggctctactgagaaattgcagttggtaatatctgataagcattttagaggctccacttaaggtcccacttatttgctgaagaccaagtgatgaagactgaatgagaaatgaaaatggataaggtaaagaattgagaaaatcacagtgatgtgatgatatatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattatgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatgccctaaggacaaataggtcccacagggacatggcagatggacttccaggcctgggaggttaagattgttgagcagacgcaagctgaagctttgtaaggtctcccaagagaggtgtaggaagaaagtggatggaagaacattaactaggataatgattgcatcattaaaaaaatacaaaaaatgaaccctggagctgagtggaaataatatctccaagagagggtgatctgttcacagcctggatgataattggggccaaatgaaattattcagaatgagtttagcagataacaggcccacattaattgccaagactgagtggtgtcctggggccatcacacagttgaagatccaggttcattgagggaaatggactgtagagggcaggcagatgtcaggagccagcagagaaaggcaagggtggaacagacagaccacctgagaatgctgttttctccccaggtccaaaagtggagtcacatagaaagggggactctgagcaaggttcaaagaaatactgctgcatcaacaatgtctacaaggagccagataagacccagtgactcttgctttggtgatgttttagggttgaaaaaattagtatggagagataagagtcttagggtcaccattctgtggaagtatttcttgagattggatactggagtgtgtgctctgctgaccacaaatggtgtgttctcatgcagtcatggccagtgactggagtggacacatctctctgcatggctcccacaacagtccagcaggccttggcttgatggacacctaaggcttggcagacatctcagcttttggggacatctgtgagttttgtccaggttggagatggagctgtttttctgactcctctaggaggcagaagaactatgctggaagtggtacagtatcattgaagctgatcaggcaggctccaaggaatgcttgcttgcatcttataataaactggcctcaagaatctccaaaagggaaaacatcatttccattagagtcaagggtgtgtccaagcatattaaatagtctatagcatagcattgagtgaagtggaccaacttgtgaccactcaaaagagtcactactgactaagctccagatgctaagcctgccttgggcatggtataagctcaggctcttgctgacaaagtcacagagctaattagatgggtgaatgcttatgtcatccattttgccaaagagaacagttaaagttaatatagctgtgtttcaagggatagaagacaggatagtgattttagacagccacattatatgttgtagttttaccttttccaattattagaaaaggagagttttgttttaatgactcactaatcatgggttccttagaaaaataaggttaatttgatttgtctgtatttatattggtattgttcagttgaacaagataaggacaattatcgataatctccaagtatggggtagtctacaaagtagatataagcaacaactgtaccctctctctttgtttttatttaatgtctagaaatctaagttatcacatttgtcaaaagagctccatcatcatgattggttaaggcgaagggaatacacagagagaatgtggaattaattaattcccaaaccaattccctgttgcacttaagctaagcctgtttttactttcagccaccaaataaatatttctgctacatatatacatcacatgcctactatatgccaagaagttctaagtttttaaggatatggcattcaaactgatcagaagtgcaagcttacccagggaccagcaagcaattcttataaaaggtctaaaagaaagaaatatgagaagatgaagctggagaagtaggtagatcatggtaagaagtgtagattttatctgggaggcttaacaagtgaagagttttcagttctgcattttaggacattggtttggaggcaaatgaaactggagtcagcctactgcaaaaatgtatccatttttgccttttgatgatgacagtcaaaacccatgcagagtgcaaacagcatttaagaggtggaactaaaaaaaaaaatctggtgacctggtggctgatgaaaatattgagaacaagtaggtggctcagtgaataggcaaatggagaaagaagctagtctgggagaagattgtgtgttcagttttggaaatgttcaacttaaggtttctatagcatcttgtcaaaatattttggaggaagtaggattagccaggaagtaggatgtgcacgtttctgaacttagaagcaaggctctgacagctctttttatggggcctttctctggttttgtttgcagcaggaaatcttgatgttttcttgtgggacaaagagcaggcttgcttacacttgatataaaaaaggtagattcctaagctcagtgtttctatcttgtaacacaaaccactgcatgtgctggcatccttctggacccctctacggagatactgaggttataagatccatgagagtagactggtgaagccaaaattcttctgggaacagtctctcagtgggatttcatattctctacacaggacattccaacttatctttttagtaattggggaacacataaggacattgaatcataaattacacatggttttgctcctttcttaaaaagttcatggtccttattactctctccaccccaaatctctagagaatggaaaggaccttatcagaatgggaaagttttatcattagaaacataaagttatgaagaccctttatccttttatcaccttaaaatcctttagcctgatagatgcaacatgcccagaagaatgatgagtctaccagatattccagaaaagaggttccagatgcctagcaattacaaagtagaagtgagtgagtggggatggagtgggaggtgaggaaggttactatgtatgaattgttagtggtatacaaagtacacagcgggacgggaacattaggatggagatcaagagtttcctctcagtgagatctattggattatgaagtagtctcccaaaggaagtgggaagaacacagtaaaagcacaccagactagaaaatgcactgcagctaacaattctgcacttgacatgagattggagattacctaataaatcttttctcagcctaccttttaactctaatttctgtgatacgtagaaggaatcattaaagggctggagaagaggttttcagtaactggaaactagatgtcacagactttttaaaagacttcttaaagagttagctacttgaaggcagaaatttcccttctaagagtcctcatcacttactttgagaaatgatcaaagtaatttatcatttagaggagctctttttcaatagcttattgagctagaatcatgctttgttattttgtttttgtttctctccacctacccaagcccctaaggaccaagaaaatggcttccctgccttataaaatccttctgctactgctttcacttaattattcctgtggcttccttacctttagggctgttttctttctgttgcaaagcttcttgaatacatgttgtccacctgtgtctactgcctcatcatctgaaatctcagctttttcatcagtcactccaacaaatctactctgagatatttccagtgaccctcttcttgccaaatgattattttcccagtcctcttaccatgtgatatttgacacccttgacattggcccctcttaaaccatctgcctcacatctgctacacaggaggtcctggtctttttcctcttaatttcctgtttagtcttcactggcttttttgtttcctctgctggcccagtgaatgtaaagaagaggctactctcttcctcctcttctctagctttggcccttgccaaagtgtgctccccaatttttcttacctgttccctttctttcattctcgtgggttcagctatgatcaatcttaattctttaagcttctgttctttaccaccaactgaccactgggcttgtctgcctgaatttaccaatgcccagttcaaattcagaatgagaggtggccatgaggcagtggaagagacactaaatacttgggtttcagccttggctcttcctccagcagccaggtgaccttggcaaattactcaacatcttcaagacccagatcacttgtctaaaaatgaggggctgggtagggccaatcatctttgaatagtacttgatggaacctcattagctttatagaggtgacatggatggtccaaggggacacatctctggaattctactctttcactcctttcttttgcttaatgatacagggctcctatgtaaagcttcatttaaagaaatgtccttaggccgggtgcagtggctcaagcctgtaatcccagcactttgggagactgaggcaggtggatcacttgaagtcaggaggtcaagaccagcctggccaacatggcgaaaccctgtctctactgaccatacaaaaattagccgagcgtggtagtgcatgtctgtagtcccagctacttgggaggctgagacaggagaattgcttgaacccggaaggtggaggttgcagtgagctgagtttgcaccactgcactccagcctgggcaacagagtgagactctgtctcaaaaaaaaaaaaaaaaaaaaaaaatctgagtccaggtccttcctaatgtaattttctaaaattctataattttatgactaaaacccagttcatctcactcgtcaaactgcatcctcttctaacttttctgtttttattaaagtcagcatcattcttccacttgctggcgctcaaaccctcattttgtctttgattcattctctactatcccctaagtgcttttaagatgtctctaaatccaaattctctcaagtgtctgtgagatgtctctcctgctgcattcccatttccactagtgctctactctcggttctacgtgtttcatactttgttttagggatgcggtctcactatgttgagcaggctggtcttgaactcctggcctgaagcgatcctcttgcctcagcttcccaaagcactgggattacaggcatgagccactgcacctggcagatttcacaccttgaccattttaaccgctgcaggaacctcctactttgtctctgcctctaggctcttcctcttccagtctatcttacataataccaccaggtcaattttctaatatgtgacttttatctcatctatctctggttaaaacttcagatgctttctgataacctacaggaaaaagtcagatgctgctgcttggcattttgggcttactcctatcaaactagcatatcttctttctatgctatgtccagaaatgctcttggaaagctctctcctccttgccttgccacttcctacttacattttacacacagcacaagtcctgtatctcccagaggcatctgtttcaggccacttgcaaggcttccttatctgcacacatttcctacgccacttatatggcagttcatcacttatacatcacatttcacctatttgtttcctccacaaaaccactgccttctttagacagtaatcacatctaagcaagtgaggcagaatggccgaatggaagctgtgttctaaatctgtcacattatttacatactagataactttaggcagggcatttctctaagccttaactttctttaatgaaaaacatggataataccatgtgcctcttccccatggttgctgtgaggaccaaatataagtgagacagcgctttcaaaaactataaatttctaggaatagattgtggcatgattattacaaccattactcacttttatgattcacaggattgattggatatggaacaagtgttaatatatacttggggtactgaatccatgcaacaattctgtataagactttgactacaattatataaaaatatttatgcaaaaataactgtggttgtattcaaaaatagtggatattttctattttctctatttttctgtcagtgttgttgttattatccttataagtaaagaaagaaaaagaaaccaatgatatacagttgttgttttgaagagctataggtaaggacagccagttgctgaatacttaattaagtaacatactgagtgacatcacccacaccctaaatagagaaaccaccgccatgtgacttcccctatgaccctccaagggctggcggcctccatagctgctagtgcaagatgagtgggacagtcgacaagatctatgtggtaaagattctccatgtcaccccggactctgccagcagcataccacaaggctcgttttccttccctgcctgcttgttccatggccttcttgtgctgttggctcagttctgctaattgctcataggccctactcttaaacatcacacttcatgaaatcgggggccctatagataattgtcaagatgtgtatcagctacattcttatcctttactcacattttgcaaagtttcaaaagcaatccatcaaatgatgtgccagttgccaataaccttcaaattattccttatatgattagaactgtggttgggggaggatggagaatggagatatcccttcacactttcctttatgggcacatagcaggtgcccagtggctgataaatgaaagaatgagcctcaaacaatggcctggaatattgaaaacatgatgatttggacatagaagacactggttctatttgccgctggcctgctgtgtttctttgtttcatttttgctgtttgtacaaagacaggattgaagtggatgacctccacagtgtcttcctgctccctgattccatgcctgctctgtgcccttttccctgacttggaccttcccttcagattcaggtagccagcttggtacagaccatataaacttatcctttatttctgatgccagtaagaattagagaggaaagaggaagcagagtgagaaaaacaataaaaaaccaaatggatgaggaaaggattgatgagcatgagtgactaagctttagaattttttatggtttcttatgggaacataagaatgcatccatcccccaatagtgagcaggatcgcaggaatttcctgtggggcagcaatcccaaggccttgctgatctaatcagttgtgaaatcttggcactgcccatcccgagggtcgtgggctctcaccacctctgccctttcccagcagcctttgatggtcaaggtctgtataaggggagcctcagaggcccaatagttttcagcatcagagagataatctgaaagcagatgtgtggggctccaagatgcagtgattcatcatgatgtgaccatattttacattctgagatgttccaccttattggggttcaattgccggatcggaagcacatacattatgtctttagacaactccaagaaccgtgttttctaagatttccaattgcaaagattaaaataggcgagaactagttacggctcacacgaaggaccctttaaagaaagataaaaactcagtgtagtttactgccagagatatccagatacagcatttatcctggtggccttctttctaggtcatctttggttatatttatttaacaaacatctgtacagtacttactatatgcaggaagtgttataagcacttgacaaatataaactcaattgtcataagtgctcttcgaagtcaggctattacattcttaatttacaggttaagaaaatgaagaataatgaggctaatgacttgcccaaggtcacaaaactagtaagaagcagactcaggatctgaaccaatgctgtcttgctccagagtcctaaccactacactaggttgccggttgcgtggatattgagtgcctgtggcgctctgtgaccaaatccctcctgagggctgcctatagtcctagctcactcaggagccagccaggctccaggcaggcctggtgagctgtggttcttgcataaacatgaaaggaaaggggagcagggaggaagccacccacgggctggctgaggagcagcattagcagggactgagggggctggctggctgctgctgtttgcgggtgacggacttctttagtgtgacttttaaccacagtctgcaacagggagggatttcaaaggcagagtgctggggccaatgaagaagaagaggtgggacacatgctctcttgatttgaaggatgtgggtaggggaaggccaaggtcagaggagcactccaaaagactgtggttgggccacatgcaggattggctgggcaggtggagaggctcaggcaaggaggccccaggtgcttctccagccacaccccaaggatgtggcaataaggtggaaccacagaggtgacaggaagagaaagaaaaggtggatagagaagccattcggaaggaatggaaagaagccattctgaaggaagaatggaaagattctatgtgtgaagcagagaggggcgagctaaaatcatttaaacaagtcaggtctacacagctagcagaatattgataccagaatcagagatcacgaagaattagaagtattgcctctaggctgggtgcggtggcttgcacctgtaatcccagcactttgggaggccaaggcaagtggatcacttgatgtcaggagaccagcctgaccaatacgttgaaaccccgtctctactaaaaatataaaaattagccaggcatggcagcatgcgcctgtaatcccagctacttgggaagctgaggcagaactgattgaacccaggaggtggaggttgcagtgagccgagatcacaccactgcactccaacctgggcaacagagtgagactccatctcaaaaaataaataaatacataaataaaaaagtattgtctctaatattttaaaatattggagctgaggtcttagaaaggcagctggaaatagggaagatgagggtgatgagctctcaccacctgtgccctttcccagcagccttccatggtcaaggtctgcacaatggaagcgtcaggagatttttcatggtagtacttcaggctgtgaagggcgtggacttgagtagctatagcagtgtgagttacattttctacatactgaagagaaacagctatttttgagatcaagtgtattttttcatttggttatatctaccgtggcattcaggctgggaatacccctttccagcctcttgcacggtcccagtgcacctgttgtccccacagaagtagcaacagtgctgcctttcaccctcaaagacatctgtttgaattttatgtgatgactgtacctataatctctacagagcaacagtgtcctcagtacctggcacagtgctctgtacacagatgcaacatatatatatatatatatatatatatatatatatatatatatatatatatatatattttttttttttttttttttgagacggagtctcgctctgtcgcccaggctggagtgcagtggcgggatctcggctcactgcaagctccgcctcccgggttcacgccattctcctgcctcagcctcccaagtacctgggactacaggcgcccgccactacgcctgtctaattttttgtatttttagtagagacggggtttcaccgtgttagccgggatggtctcgatctcctgacctcgtgatccgcccgcctcggcctcccaaagtgctgggattacaggcgtgagccaccgcgcccggccgcaacttatatttttaaaagaaaaaatataaatagtagaccctctaatattacatcaaatgaatttgttactacatagacaggccagacctcatgggtgaaaatgactggccatcataagggtttggtcagtaccctgggcctggagtcagctagaagtctatgaggaatatatatgtatggtggatagtgaaaaaaactatgcaatcgctttggacattttacagccttttggtccctaaatacatttattgtagtatcattttaaaataacacaatttctttaatctcgtaggctgaaggaggtaaggaagttaatttttcatttgtatctattatcaatgctttcaatgttttaagtattaacttttaatttttttggagaccaaaccataagcttataaccttttttcctttcttttccaaaatatataaccttttctctttcttttccaaaatataagacatattttctagttgactttcttagtaataacctttgttttctcattacaaataaaaatatgtattcactgtagaaaatatacaaagtaaagattaaaaattaactgaaattctactaccaagatataaatgctattaacattcagatatttgccttttatagtttatatataaccccctcccacatacatataacatatatatgtgtttgcatatacacatacatgtatatattgttgtttaactcttatttgaaaaataggattatgatacatatatagcccccaagtagaatattctacataaagaacagagactttgataggaaaggatcatttcaatttcttaatgtttcccattaaatactaagaggatcactgctgcctggatcataacttaataatgactatcacagttcacaccatgcttaaattgtggtctcaagctggcaatgaaatgactttcttttggtctagttttgtgacagccatgttaaacaaaaatgatctaaaaatgagaaaaaaaaaattcctttgtatccagtaaccccattcattatttaaactgttgtagtattttatttttagttttactatatgccactgtagacataaccaaatgaaaaaatacacttgatctcaaaaatagctgtgtgtttctcttcagtatgtagaaaatgtaacccacactgctatagctactcaagtccacgcccttcacagtctgaaaaagtactaacatgaaaaatctcctcaaccaataaaactagagcagcaaacagaagacattcaagtgaaatactttttaaaaatgtatgtatgtgcatccagaattagtcggtttgatttatcttgtatgatactaactctattgctggtaaagattaattttattatggtgctcctggcatgttattttctcagttcatttctcagtatgacatttcttatttttctctgctacaaagcacccactatcataattttcacctgctgagtttatgttactgatgataatattaaaatttagagggttttttgacctttctagtggtaaattaggtcataaaaatagatgggacacaatctgataaatgagaaagagaaagatttgattattattaaagtaaaatcaaattttacaaggttttcctggcatactgtgagatcttagtaaacattgaatatcttccttctctcacacccccaaattgaattctctctattcaccgctgccttgcatatgccacacatgagaactattccaagaaccaagcgttcctgattgcttctgcatggtgcactggagatcttctgattataaaccaaataatacaaataatagtggtgataataatactaacagcttttattgagtgcttggtagatggcaggtgctggtctcttactatctccattttatagattaaacactgaggcacaagtatgcctcgctgtttaatctgtaaaatggagataataatagtaagtagcttccttaagttcacacacctggaagttagtggcatcatgactgggccccaggcagtgataccccagggcctttagtccatgctgccttctgtctgaatgatctctccggaaactatagcttctccacttggttcaagcccttgatcccaccccaagtctgttccttactgagaagcctgcagtcagtcttgagtgagttcccttttcagttgtgtgccctctcttcattgggcatgtgctcctggaggacagtgactgctctgtgatccaatgtgctcccaacaggcggcattgtgcctgtcatgtggacttggatggaccttgttaggagcggctagttatgggtccactgactttttttgcatattatccaaatcaatgtgatttcttaagaaccagagtctcacaattactaatgatgtattttcttttgggggctgaatggcagcaaaattcaacatttggattaaatgaagtatctgtacacctcagttcagtataatttgattgaatttattgagcctcctcctcttttcatttattgagtacctacaataagggtacattttgtgttaagacaacaagattcaaagatgaataatagtggttcctgctatcaaagaatgtaggagtctatagggcagccagctatgtaaaatgtattaaaatacagtatgatataagccatataaaatatattaaatacagtatgatataagccatgacaaaggaagagccagggtgctggggaagcccagagtggcacctagcctgtcctggggtggagagtttgtggaaaagtatggtccacagactggtaacactggcattatctgggagcttactagaaatgcaaattctcaggccccagcttggacctgcccagtggaaaactctagggtagggcccagcaatctgtgttttaaaaagctatctttgattcgattgcttattaaagttcgagaagcatagcctcagagaacataagactcacaggcacaacaattagacaagaaaacatatatctaattaaaacctgtaaaataagaaagttggatgatgtgatctctaccacctcagttttaactgtcagtccacgagacttttatacacatcttaaagttaactggagtgatgtgtgtttatcttcaagatcacctgcagataatatgcagaaggaagatttgtacttctcacctaaccactccaaacagattcatgagctgactgaggctgctgcacttccatcaatgcaatcatcaatcgatgagtgttactaatgtatctacctgcataggctcattactgtgttaggttctgcaaggaatacatacaaattctccactttaaggaacatgatctgagttggggagataagcctgtcagaagtgggttgttcaagatggttggaatgatgataaattgtaggaatctagagaagatggtgattgatttggactgatcttagggtaaggacctaagaaatgggaattgaggtaggcttaaaaacaggcagaatttgcattgcagacaaaaagggcgataagatagatggagaagctgagttatcaatacaaaatctaattacttagaatttttaatgaatggtgcaccaagctgaatttgacctgctgactcaagccatttattcaggaaatcaggccaacattttttctgaataccaggctgatggttattccattttcaccaaggggactagtttgaatactgtcatataaaatggtcaggaatgatatatatgcttacagctgtgagacttatatgttatgcatatatgtgtgtgtgattgtgcgtgtgtgtagtgaggggacagagaattatactgacacaggtactggggcttgatatagattgtagttgtatactgttcccatagtttcaagtcatcttcctaaaagttggcatggaaagaaattgcctttgcaaattagattctgcaagtctcaaacataagtagctcaccagcgtacactgaacagtctggaaattgtccagacagagaaagccactctgtaatctcacagagaggctgatagaacaatagaaacgacgtgttactgagcatcacggccacaagtctcccctgcaaggacagtttcaagctgggaaagctgagactttgaggtttttcttggaaaaaaaaattaatagatttctgctctattaagtgttccaagcctggcggaatgtcttcaggggaacctagagttttcagagaatggcctccatatacctggcaaggtgctgctgcccagagagggtgacagggaaagacttccctggctctgatgtctgcacagcttagaaatgcactctttctttttattttcttcttcaggaaactcttgctgtctttcgataaaaacataatttaaaactgtaacaaaacatgtgaatgtcttttcctttgggcaacagctttccttccaaattcaacttttgctctgcctgaattaggaacacgtggaggagataaacattgaggtgcagtttgctgaatttctgacttttgtgagaccctaggttagatttaaagccaccagtgtggggttcatagtcttggaggtttgatttaaatgcccagttatagctggctacaaacaggatgtcaggtccccctgggcatggtggcaggtcagtaaggagggaaggtgtagctgcatttggtggccatgaactcacaactggggatagttctcactgttaggccccagcaagggaaggggggatctccatcagagctgggaagagttttgaggttggaaggattaagacacactccagtttgttgtgggaaatttaaacatatttattgccaagtccaatctttgtttcccccaggaagaccaccaaacatgttacttgtagactgacatttgagcttttttgcttccaattcaagagccttattttaggataagcatttcattaagtgtggatatttgtgcaactgcaaacatacctttgatgcaagcagatttcacagctagagttggcaggagagctgcatgatggtgaaaactgctgctctgccgcctgccagggtcaatttagaagggctgacacgcagggcaccacgacacttaggcagctcttcctgttccagtctttcccgcctttcttcccttttttcttcattctatctttgtacctacttttttccttgtcattttcctacatatttcctcaaagaaatgccacatcccagtgagctatgtgtcaatgagatggatgaggttggagatgagcagtgtgtgaagaaatagagaatgactgccctttgcagcactgcagaaccatcctgggagagctggagagtaccaggcaaggaatccttgccaaagaccaatgtcaaagatggagtcagaccagcactggctggtgcatttcacaactctccccttcctggtctcacgtgtggttagcagaaatgaagtggtgcgaaaatcactatggaatatttaataatctaaatcataaaaacaaatgtctaggaagccctatggctcctgagtagcatacagaactaagaggaaggggagttcacctgctggtgcatccttgctcctggctgcttttataccactaatcctggtgccttgtcccctcccctgctgccttcatgaggcactagggtaatctgcttctgtccaccttttgggctcccgactctttccatagatgctactgaatgttcctcctgttccttgttgctcagggtatcaggcagtgctaagccatacctcttgtgaggcaggaataccgtaattgagccctctaggtttatttgactttaaaatgatattgcttgcatgcaagtcatgtctgtatgtttgtatatgcatcccttgttgatggtttggagcttacctggaacttcttggccataagtagaaataaatgcttaattttggggttgggttagaactcattttgttaaactttaaattaatcactcttcttaatctcacatattttctcgagaggatggacaagtctcatttgggtacggatggccattaaccttggtctggggtccatacagagcataggctctagaatccctaggccacaaagaaggttcggacatagagttcacagcacacgacctcaaataatatatctaagtattgttctcctaaattatttatgtagtatataaaatttgcctttctcttcaaaatgcaaatattattgaggctatttcctctcctgttgaggaactcagtctcttctctatgtggtaatatctagccattattatgggctgtttatttcattatttaccaagtaggggcttagctttaattaaaaaaaaatcagtgaatcttcctctgttcctaaattccaatcaagtacaaaagcttccctatttataaattgctttaaatgatagctgaattaaccaatacattgtcaatatccactgcttattatccatgagaacaaaaataagattttaaagtcccacagcagggactgattaaagaaattagagtacatctgtggcatgaaatattaggcagtcattaaaaatcacaaaacaactgataccacagaaaacacaaatgatccttagagtctatcatgaataactatatactaacaaatcggaacacctagaagaaatgcatacattcctggacacatataatctaccaagattgaaccatggagacatagaaaatctgaacataccagtaacaagtaatgagattgaagcagtaataaaaagtctcttacaaagaaaagttcagaacctgatggtttcactgctgaattctaccacatattaaaaaagaagaacaaatagtaatccaattgaaactattaaaaaaaccacaggccaatattcatgataaacatagatgcaaaaaatcctcaacaaaataccagcaaacctaattcagcaacaaattaaaaagaccattcaccatgaccaagtgggattcatcccagagattcaaggatggtttaacatatgcaaataataaagtggtacatcacattaacagaaccaagaatggaaaccatatgatgatttcatagatggtgaaaaagcatttgggaaaattcaacatctcttcatgataaaaactctcaacagaccaggtatagaaggaacatacatcaaaataataatgaccatatatgacaaacacagttaacatcatacaagatagggaaaaacggaatgtttttcctctaatatctggaaaaagatgagaatacccattttaccacttttactcaatactggaagtcctagccagagcaattaggtaagtgaaagaaagagcatccaaattggatggaagaagccaaattagccttgttcacagatgacatgatcttatatttagaaaaccctaatgactcggccaaaaaactggtagaactgatgaattcagtaaagctgcaggatacaaagtcaatgtacagaaatcagtagtatttatatatgccaacagcaaacaatctgaaaaagaaatcaagaaaactcatttacaatagctaaaaaaatgtaaaatgcctaggaataagtttaagtgaagaagtaaaagatctctagacaattatgaaagactgatgaagaaattgaagattacacaaaaaaatggaaagatattccatgcctatggattggaagaagtgatattgttaaaaaggtcaatactacccgaagcaatttacagattcaatgcaatcgctatcaagataccagtgacattcttcatagaaacagaaaaatactatgaagccacagtaaccaaaacagcatgctactagcataaaaacaaacacataagactgttaagagtagagaacctagaaataaatccatgcatttatagccaactgattttcaacaaaggtgtcaaaaacatagattggggaaaggacagtcttttcaataagtggtgctaggaaaacagtatgcagaagaatgaaactagacccctctctctcaccatgtatgaaaatcaagtcaaaatggattaaatacgtaaatgtaagaccagaaagtatgaaactactaggagaaaacattgaggaaatgctccaggacactggtctacgcaaagattttttgaggaaaacctcaaaagcacaggcagcagaagcaaaaatagacaaatggaattacatcaagctaaaaagtatttgcacagaaagggaaacaatcaacaaactgaagagacaacctacagaatgggagaaaatatttgcaaactctccatctgacaagtgattaagaaccgtaatataaggaattaaaacataaggaactcaatagcaaaaagacaaataatctgattaaaaataggcaaaatatctgaacagacatttcttaaaagaggacatacaaatggccaacagttttatggaaaaaaaaagatgaacatcactaattatcagggaaatgcaaatcaaaaccacagtgagatgtcatctcacctcagttaaaatggcttttatcaaaaagacaaaaaataatggatggcagtaaggatttgaagaaaggggaaccctagcacgctgttagtgggaatgcaaattactacagctgttgtagaaaacagtatggagtttcttcagaaaagtaaaaatagagctaccatatgatccagcaatcccattactgggtatatattcaaaagaaagaaaatcaatataccaaagagatgtattgatatattgcagtactattcacaatagtcaaaataaagaatcaacctagtgtccatcgtcagatgaatggataaagaaactgtgatatatatatatacacacaatggaatactatttagccatacagagaatggaatcctgtcatttgcagcaacgtgaatgaaactggaggtgattacgtaaagtgaaataacccagacataggaagttagacaccacgtgttctcactcgtatgcgggagctaaaaaagtggatctcatggagttagagagtagactggttgccagagtccaggcagggttagggttggggatgaagagaggttgattattgggtgcaggaatacacttagataggatagagtgtgatagttcagtaggttgacaagagttaacagtaatctattgtatatttcaacatagctaaaagagaagaatttgagtgttcatagaataaagaaaagtgtttaaggcagatgatatccaattgtcctgatttgatcattatacattatatgaatatatgaaaatatcacaggtacctgaaaatacgtacatctattatgcactgataaaatacattttaaaaacctatttaataacatgggcaaatgctcattattgataaagaaaaatgtaggttgtaaaattgtccatatgatatgctataaatttgataaaaatgtatatacatgcacataaacaaagataatggaaatacaaagaagtggaaactgatttgtgagtggtgagatggcaaatggttatctttttattttttctgcatttctacattttccacaaaaagaaaatggtacttagggataacagtatttatgcatatttatatgtatgtatattggctctataaaagttaccaatctccattcaaaacaattgcttttgcatttatctctggtaggattatcatgaacctttctgggggaggacattctgtctccaaaatgggtaacttttgttcagatcttggttttatctatacaggtatccatgtccatgtcagaccatttcacacagcactgaaatttgtttcctttgcctgattttctctaacctggcctggaggaagaaggtattttcacttctctaaactcaatctgtcagctttattaaacttgctaatcctgttacatgctccaaattcactaatgaccaagcaggtaccaccaactctggccctgataaaaaggacaaacttctagccccagcctccagcagtggaaacatagtcagctggcattgaggtgtctgggaaggaaacttctctgagccttgactggatacaagaacattcaccgtgagccagcttctgtctgtttttgacagcagttccctctctaatccttccttggagctctgtacatgctgggatgggggtgtcctaacaaggtacctttgcaatcattgaccttttcaagggtgctgggttgggacatgtgtggattttttcagttggaactatgggtttcacagtgaattgcagcacatacagttaattcacagcagaaaatgtggtgaaacagctggaagaaggcagctgcataggggcaggggttgtagagggagagcagggttagaggtggggaaggaaacattggcaggagaaaagcaataatgttacagggctataactgggggagaagagcaagttctgggtatgagcatttaatatgtggacagggtaatatattcaatagggtaaaggaaatattagtccacgaaaaatccaacttcttgacttcaggcatctgcagagcaaaggtgacctcagacatctacagatatgggcccatccctctctaaagggaagacaaagtggctcctgattttccagttgagcttttctggaggccgtaaagttctctgtaccactcattgtgccccactcctactagactctcctcccaagcctaccatggagccagtccttccaaaaaaggtctcgtctccagaggattgctggaaaaatacaaataaaattacttcaagctcatcattcccactgtgatactgacctacaggcagagaatgaggcctgatggaatgaaacaggactagcaggttttggtaagtgaaaggcatgaggacatggagtcagctccatgtgggggcagaaatcccatctttattactcatcactgggtctccaaaaccttgcccagtgcccagtgtgtccaaggctgggtaacagtaatgtctaacacatgctgatcacatcagcactgcaaagcaaggctcacagtaccctatgaggtaggtatggttattaccttaattttggaggtgaacaaaatggaagtgcaggggttcagtgtatggcttagggtcactcagattgaaactgggctgcttcatgtccagatctgttcttaacctctacactctgctgcctccctcaatgaatgtttgtgggtgtaccaagtagaaagtgatgtcaggctgtgtggggacacaaatgaggtctctgtacaggtcaagggcagcaaggaggaaggctggaaggagaaacatatggagcaggatgcaagagctgcaacacctttggtcccaagctagtgcttgctgggcttagtcctggtgggtctgggctcattttccttctttttttctttgagacagagtcttgctgtagcccaggctggagtgcagtggtgcgatctcggcttactgctacctctgcctcgtgagtcccagttcaagcaattctcctacctcagcctcccgagtagctgggatttacaggcatgtgccactatgcccagctaatttttgtatttttagtagagacagggtttcaccatcttggccaggctagtcttaaactcctgacctcgtgatccacccacctcggcctcccaaagtgctgggattacaggtgtgagccaccgtgcccggccttattttccttttgatagagctgtgggttggggtgaggaaggtgtgaaaccttatatttgtccctttctgctttgtctgctcctctcccagttcaagatcggggcccctaagaccaagcagcaagttctgggaagaaagaatccagcctgagttgttttttacctttagaagatacggtcccattctttcgtacaggttgtctttttcttttttgccttgtttggtacatcagtatgtattctctctcacgcctccctgcctaaagggtggaagctacattcagaaactgagcagaggactcagcacatgcagaggttccctcacatacatcattaaaatacatggttaatgatagccttctgctgtgctgtactaaacttgaagaatgttctttgcacatatctcttccatacgctcctaacgtctttactctgacagacttaaagacagctctgaggatttactttcttaaggaggtgacgtgaaaaactgaaaagtcttttttcttttgtgtttttgtttcactggtgaatgggaaggtgttctgtttgacagtggcaaccttcagcatcaccaattaaacctctttacaaattgcaaatgatttctttaaccccagtgtgggagtgtgaattgagcaaatagaggaatgtgaggtagcaactttactataacagaaacaaggacaggaggagagaaaattcatggaaagcttttagatcaaattgttttaaacattgctggctgaagctgtcactgcatttcattcctcctacctgatcctacagttctccctcctcatccttcccctccaccagacacacacatgcaaggatcataggtggcgatcctgctgggaagaaggtcatcaaaaaagatgcaagataagaacatgatatatatacatatatatttacaatttaagatgttgatatctgttatacataattaccagggaccaggttattcagcagtcctaggaacgtggagatagctcagagacagagatgaaaagaaaatttataggtttgctttccaggaaagaaaattgggtctgaaacaactgaaatccttaaagaaactggaataaaggttagttttaaatttggttacacttaaatggttgacttgcctatctgtcgttaatatatccagttccaactacaaagagaaaacaaccagcaggcatgagcgtgaactgcacaagtcctcttggagaacaaggcctttgcagttgacgtcagtttctggccctaacagttttaaatctgctttcagaaaacttctcctgggcatgcattcgcagatgatcttgtgataaggggcaagggttgggctttttaagggtgtgtctgttttgagacctcaagcatgctggacaatgtgttggtcagatcctggtggtacacagtagaacgtaaaaacaacagaaaagtaatactaacagaccatgagctagatgagtcttgagactaagacaaatgaggaaatacaagactctacgtatcctttagtggattccttcaggacgactaatagatactataagggtgcagcagctgcaccaacattctgaatgccaggcaattccagaagtttgaagctccctgtcagactccaccacacagctattaatatacagaatcccccagaaacaaatatgagatgcaaccaagatttatggatatgttaattacagatttataatagcaaaaacaggaagttaaatgcctgacacacaggcgtgtggttcaattatttcacatctacattatacagccgttaaaaatcatgtctttgacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaatcatgtctttgaggaacatttggtgacaagaaaaatatttataataatataatgaaaaatcaaaaaggtacaaaactgaagacaagatgatagtatttatttattcatttatttatgggcttttccctctggtcatatacatgactggaaaaaactaaaataaagcgttaatggtggttatctctgagtaatgagataccaagattttttttccttacccctatattcttttctttctataatttgcaagcttcaaacatacttttgctttttacttttataataaaacatagtggttttaaaaacacaattgtcagctctcacaagaacacccagctaagttggcaccagtccactgtataattgttattaataaatgataatgcatgaaattcctgcccccagatataaataattataatgaaaaataatttatttgtctcagacaatagcctttggtccagaggctttaaaccttgtgttctgccttaaaattcatcctgccaaaagtcctgtctgctatattaaatactttgttatttgttgagacagggtctcgctctgtcacctacgttggagtgcagtggtgtgatctcggctcactgcaacctctgcctcctgggctcaagtgatcctcctgcttcagcctcccaagtagctgggactacaggtgcgccatgttgcccagtctggtcttgaactcctaggctcaagagatccgcccacctcggcctcccaaagtgctgggaatacagacatgaacctccacacccagcctatattaaatactattgatgcatgaagagagaattaatacttgttgagtatgtactctaggcttggtgttaatgtacatggtttcatttaacacacaaatgaggaaggtgaagttcagaaataatttgtctcagtcacatggctactcagtgatcaaaatggattcaaaccctctcagtcgggtctgaaggcctcgtctcttttgaccaccacaaggctggtggcaacttcagatgagacgtagacttcatttcagacatttaagaatagatttgcaaaatattgccagtgctcctaatgtgagggcaaaataattgatgattaattcttttctttcacataccctagtggaggtactggggaaacttccaaaaggagacaaagttcagacagaaaagagggtgagtaagtaatccaccacctgggaaacccctgataaaacaggcagtgattgtaaagattagcccagccctctgcctagggagggaggtggccacccgcagtgactggcaaggactgtcaggttctgttacttcacaaatatctcccccaccccctaggtcaaggtgctgctcttccttcctactgagccagaaccccatctctcaacagtcattgctttgagttgataacaaagcctacgtcatagactctagacaggtatcttaaaaaagctgaaaactttcctgtagaagggacaaagacctcgaagattatctcactttactttttccattgaataataagtgacttttaaaatttttcaaaaagggcctatgggctagatactgtgttaggcctgtctatacatgtatcatctaattcaatcagcagatcaatttataatcaaaacatcttagctagaacctcacaattacaagtacttccacatacattctctcatttgcttctcacaataagccttaaggaaggcaaggtaggagttatccccattttacaaaccaggaaactgaggcctactgccactttgtctggcttattggaacagacagcagcttccctggaagccacagagggactggctgtgtgtggagtggatatgaaggttttggttgagaatgtggcagccttgtgtccctggaagacagggtgctgaagaagggttttagggtaaggatgagggtcatgaatatgagagtggaaagataaactatgtctcacaacattgcctatggggagctctgtatgaatggcttcctcctttggctttctactttctcaatcctattcactccccaaaaccaaacccaagtcccacagatccaggaaacctttcttgattatctagcacaaagaaaccatacgtgtaacaccttaaggttttcccaggccttagctcattacaatattatgacatgcttttgagataggctttgccattctttttacaagtgagaaaaaggaagctcagagaggttaagtaacttgtcaggctgatacatttaataagcagcaaagtctggatttcaaactacatcacatcatagctgcctcaacttcctgtacacttatcatgtcctgtatcttgtcatgtgtttcttaattccttaactcagttgtaagttccccgagggcagacaactagtcttatatttctttgtaacccccatttctgttcccctagaacttagcagagtcctatgagcacacaagtcctcaataaacatcatatgttaaatatctgctgggtaggaacaataatgattaagtgggatttttttgatactctgaatattaggctctctgttgtatataattaaaacaagagtgaacaagaaatatataatttctcctagctctagtgtaatcaggcattcattatcatgtctaattctgtgttcagtgaaaagaactgcttagtaagcattttctttgatgaggataatcaaatacagatatcagagagatttaaaaaagacaaaatcatcaaacatatggagaggcaatgatctacagggtataatattccatctgagactaaagaactttcaaggcaaaaagaacacttgtttactttttgacaattggatattcaaggaacactaagagaggaagtcacggtgtaactgggatcttgtaccatcacacattattctttatcaagaagatggatgcactgtgctactgttctgggtgaggaacagagaaggagtacatttcaagggctattctgagagaaggggttttctctgagaccttttcagcatgtcagtcatttaggtaccaccttcgctggcaggcaaacttaatgaatatacatgcaatgcgcaactgattaccctgtcgggtctcttgctatttccctcccagtatatcatcagttatagttttggaaatacaaagagctcaaacagactcactgaaattagaatttttgatggtggggattagctcacatacttctaaattgacatttgataaactaggctgacaatagcagtgcctgtcaatcacattttcttgccaaacccatatattaatcttaagctgctgacaggcagagcttctgatttcctttatgtggtagataaagtgctacatccccatgtgttcaaccaacgtcaagcaagaagaacaaataccaggtttgtggtacctacatttgaatcctcatggctgtggccattggtctcgaccaattccttggtaccttttaactgcaaattttaaggaaaaacaacacaaaacaaaaaaatgaataagcaagcaaatctcttaagtatatcatcttgttaactgatttatctgaggttgcattttataaaacttccaatgagataaaacagatggagcacatatttctaatgagccttattggagccagtttgagaccaatattttatgaagtttgatgcctggcaaaagaataaatgggtcttggtcattattttttaaataataagattagaaagcagttccataggcataaaatgtataaaattggttcttaagaataataaatgatttcatttcctagttggattgctattaatttaaaccctgcagtgtttgcaagttgccaccagcaaaatgatgttatattaacgattattcgtgaatgatgcattttcagctgcttttaacatgctactgtgctaccagacaggtcctccttgagaatatatttgaatgactgacatctctggaggactaaagacggttgcttctttggtagagaaagagtttggatgacatctccttggccgctgaggcattagaagaaattatatttctctaatgagatttttagcagtgaacatttgaaaacatttctctttctcagaggcttaggagtaatcagttataaggaggtttcaggaaacctttaattgtcattttatcctatcctgacgcaaaacagacatttagaatcagacggcaaaggaagagggtgagctggcttgcaactgttttgccagtattttttcctgacttaggaaagcagcatctcctccattatcttttttatacctaatacaaagtattcatggtaggaaaaaatacttaagatttgaaagaaaatcaatgcacatataccaccaatgtgtttgattcataacattggttccttctggctacttgtgcatattaaaatgaaagcttctttagttttttaaggccagtcttaaactcccagcaaaaaaaagccctacccgctccatgccaaagaaggggttttgccaaaggaatggtaacatgaagaaattgaggatcaggtagttgattatggaccaaaggctctttggctcatttccatatcactcccacttaagaaaaaagtctgcccactgttctctagggcaacatcattgatggttctacacacaacagacacaggggagcatgggcgatgtatggcatatatgacaaggcagaggtgtgccacaataataggaatactgtctattatcacaggacacaaaaggactttttaaaatcccctcactcttttcctagctgagggtttcttattgtaggtatccctcatcttcatcaacctctctgctcatcccaccttaggtcctgtagcttgtgctcccatgagttcgagtggggttagctcagaaggtcttgttctttttcagcagaagtagaggactattttgtgaatgtctgttccacctttacgtgtttaccaacataaatgtgccagttgctctcctctcttttaaataaactccattcttcccattccatgatgtcctctaactctgctctcgctttttctgctcctgtttattctcccctcactccctgtctcctggcattgttcactccgctgtgctccattgccagaaccgtggaggaaacccctccccgctgcagcccacccctctccttcctcgagctgcagctccaggacagctgctgctttgttcttctctctgctccctgttcttctctcctttagctgctactctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttccctggaggggctggggcctgagggtgggaaaggtctgccctcaggacctatcctttcttgtcaggattcccagcacggggcaatcctgtgaatagcaacattccaaatctgcagagcagggtgtatctttccctgcatgtgtccatttgtttaggccacatctatgtgggcactgaaactgtttacgcatagagttactctacacaaatccaaagaaagcctcaaaggcagtggtcagtggaggtgagaggtgtcatcagtgcacatctgtgtgtgggtacagggacatggaaagaaacctgtaccctgcatggccccttttgcaagaaccaccaaggggtagcaggtgaggggctcttggacaaacagcttggtaatggcaccagcacccaaaaacatttggtgtcaggcttaaagattcttggtatctgtgcttgtaaagagctatcccattgaaattaatattgcagatttaaaattcttccttctcaattgtattttctaggtctttaatgattttagctgtttcgaatcttcttcacgttctcttttttttaaaataatggagagtgaagtgtgatgtttcacccataattgtgtgtgctctgctctttaaaaatgcatgccacaacaagatatatcaatactttcagcaaaactcagaatctatttttatgactagggtttggacttcaaaataaaggatttgagtcatttagagaaaagagaaattcacccctccccactctagtcaaagctatctaaaagaaaaaaaatcggggtgagagagcagaaaacaacaaaagctcagagctatatctggttgatttggagcaaatttggaccaactcagttccactttgctgggagtcttttcataatataacagtggaaagcacagtgatttcaggtctcctcaactgcaggtcattgtgaattcagtcaactagatttttcatttcaatctactatatctgaaatcatacagagtcagcctcagtacaagttactgaatctatattcatcatataaagataattattagttttataaagcattttcttccaaagctataaaggtttataaactaatatctgtacttttctctcacaaatcactcatacctttgggagaaaataactaaaaagatattttctggaccccaaaccattaaaaaaaaatcactcataaagtgacacagagctgactttatattttctcaaatgtcacctttgaagttatgtatacagtgtaaggttatttatacaatataaaacgattatgtgtatgaaaaatttaaaacaatctgcatttgattactcacagagggttggggtaactgtatgcaactttttccttcaaattaccattcatacattgttggcagcaagtgaaggccagaaataggaaggcatttcaagagctctcctggctcctctcatgtagatagtgggcttagatttcactctgctgcctgccgagtgttccatcttaccctgctgtaagacaatactttccaatccacttatcaatgtcaggccacacttttgtatcaaagaaagccagaatgaaatgatcaggtttacaaacttcatataaaaggtctgttgctcaccatggttagataagtaccctgatgcacagggaagatactttttaaatgttgctatgaatcagtccttgttcatgtgtctgcaggagtctcatgggttatgctgaactcattttcctcactgttagacttaagaggaaaccagctgcttactttgaaacatacctcattgccagtattttgaaactttatcgaaatttgattgtcttctggaagaaactttcacacaacactggcaggcttgggcaatctaaacaagtacaggagtgaggatagcgatgctgggaatgaggttataaattccgcatagcaaagctgctaggaagtttgacagggttcagactaattgtactgcagattactttcagtaaatgtttgcacgggtgacgcacaagggaggtatgcaatggggtgtttggactgattcataaatcagagctgtttcattcacttacttgttcctgcaggacttttagtaacgcttgtgtatgggactgctcttcctttgcttgttccaattctgactttttgttgtttaactcctcctggatggttagcaattgctgtgaaattaaaggatatttagcataagtaggattgaaggtcaggtgatttaaaaatatccacaatacccattcaaaattatgagtagaagatgtttacaagtcttgaagcttaattcagacctcagttgaccttgtgtgttttccgcactaagtatcaagggcattgcagttttgacacactttaggttgtttgtgatactgatgcacaaaacttgttttcatatttgtgaaggcatcattatattcctttgagcaaatgcctatttgtaaaactatataggatagtgctaatacattacattcatagatgaaaaaattataatatagtcaacttgtccaacgttgcttcatttcacatattacagtaaagctagctttacagtaactctataaagctactttgccaagtggctgggaccacaaaagatccttttactttctctgttatgatggtgatgttttattagatcagtaggactgaagtccaaactgcaatcaatatatcagctgagaaaactgctgatataaactgtcaaaacatcaagctatggcctacactgctatttttaagcagggccactgtatggatttttgtaagccctgagcttcccttgccctatcaactgtaactcatgtgaaggctttccttgtctgccaaaagcacagcgctgcgcagtgcgaattctttgggacatggtgatatgttaatatatacataggctggagaatacattcaagagctgcaaaaaggccctggaaacagctctgactattcagagcttcttgacaacaaaggactggttcgaaaagacagagtgcatttcttctgctactgtacataacaattgctgtactaatgatctggaaatgttagtggattcctgctatgaagagacctgtctccaatagccaggctacttcttcagggccttgacaagctggctgcagagctgcctggccagttcctaaccatcaaagcctggagaaacactggcactggatttctcaggcttaaacctaccaactggaaggattaaattaaatctccaaatctactggtttggggggattttgcagggtaggaagtactcagaaaaacacactgtgctttccctgggacttgcttgttctgctaactactgtggcactgggtataaatgtaagaacctactttggtcctgtagcataaacagtgatttcttgcaattttctaaaagctcagtgtgtcctatttcaccacctgcccatggaataatcaatcacatgtgaggtaatgtacacattccatatgcgctcacttaacaatttgtgggatttaattgtgcatcattgattaaagtacagaaaccaaggagcccattttgcactttggcacagtgacaagcacctacattgtgtccagaccgtggggaatggctctgttccttcattcacattcctgactggccctagaacagttccaaagggaactggtgccctgacttgggtaatgccgagtgaattttacttcatgagacgatttcaaatccaatccttaaatctcttttgaaaaatgagccaaatgaaagataggaagttgtcttcaaaggtaggtagctcatgtttgcttattgcagcacttgaggtggcaaaaccaaaaataactgatgtccagaagaagggaggtggacattaataatcgtgtatctgtatcatcagacactatgcagccatttaagatgaagttgcacaaatgtcttctaatgacacagaagaagctcaaaaagcactgctcagcaaaaaatacattcaggttacaaaatgtaactttgcagcatattcataggaaaggatctagatgctgtctctgggtgggtgggttcatgtatctttcttttttgcttgtcagttttctggtatatctgtaacacatactgctttagtaatgagaaaaaatcaaatgaatttaagatcggggaagaacaaagagaggaatactacttggacacctctctcagctattaccaatactgtgaataaataagagggagaagtgcattggagtcttcattgcatccgcacacttacaactcttccttctattaaaacacacacacacacacacacaagcatgtgtgtgcatatacacccctttctcttgaccactctttttcttttagcctccctcttatctcatccattcttggattcacactttttaaatgaaatgtcttccctctcatcagtgcttccttttcttcttatgtgtcagtgatgtagtgtctagatttttatttcaatgtgtttttccaaaacatatattgtcattgttttgtgtgtttttttatgtgatattatgtttcttattgtttgctatgttttaaattagcattatgtttttaagatccatccatgttactatttttttgttaatgaatttatttaaaaatctaatagattttccccttttattcccaaaatgtgctatacataaggaaactttgaaattcccttgagattttactgagcttgatttattattattttttattatactttaagttctgggatatatgtgcagaacgtgtaggtttgttacataggtatacacgttactattttatgtatctaatccatgcttctgatggggtatatccaccccattttacccaacccactctcacagtgaaggccattcagattaccccaattcttcccactgtatacaagcctgcaatggaatatgctagtgcaagttcccttatggccctgtgggaggatttccctgggatgcatatccagtggtggaactcttaggtaaaagagtgaatttggcaaagctgctctctgggatggttatgccagtctacctgcctgtcagtggtgtgtaagagctgctgtgctctactgaataataacactaaaagcattgttcggctttctaattgttgccagtttaatagaacaccaagattcttcatctttgaaaaattttgtacttctttgattccctgtgattttaagcatcttatatacttgctagctataggggtttatttataatttttaaaatagtcaagagcagtggttcttaattctgactctccattaacattatctgtgaagattttcaaaaaaatacttatttctgggcctgacacaagaccaattaactcagaatattgagaggtgggacccaggcactgaccatttttaaaacaccttcacaggtaattattctaatgtgtaactggggatgaaaaccactgtatcctgaaatgcttatttaatcttgcttatttaatcttcagtctactataatgtgactttaatccctagtactctactcagactgttctcactacagtcaccagtgccttgctaattgccagctagtattccaggttcttttcttctcactacacgctctctccaggggatcctattcacgcccatggctttaactacacatcacatgtgctggtgctttacaacactgcctttacagcctctgcctctttcttaccacctaccagacccttcacttcctgtgtttacaactgtgcccattagcacacctacccttcccaccccaaccagtctaaacgtctttccctggtaaccagagttaaaaccttgaagtcaacgctggccctttcatcaccttcacaacctctttgccggttccttgaccttttctccatcccatccttgctgtcatagtaaaggctaccatctcctctcctctgggtttttcctgttccccctgccatttacccgacactcctgagagagttgacttcccatgaattaaagtgctcccatgattaaaagtactgttaattctctaacccctatagataaaatctaaaccactaaactcatccttccccagacatgccagctgcttccatgacttatgacaagtttaccactcagaattctgcctggcttattcctactcattctttaagcaccacctcaaatgttgcttttggcccaagatcaactcagatgatgcctttgtaaaactgaaaagagccccatcctctctaggtagagacaatccctcaccaggcatatggttgggcactggctttgaggcttgatttcattcccacttacccctttggcctgctgctcttgtccagggcagaacctacactacgaaatgcggtagccttgggttcttgctccaaaaaaatattctctaatcactgaagcaaagttagttcatctatcttcttgctcccaaagcacttaattcaatataccacatttcatatctgtcttcccaaccagactacattcaccaatattaaggtcaatgattaggttacctctaatatataatagctgctgaatgaataaatgaataaatgaagggataaatgaatgtttgctcttgtttccccacttctatgggattaaaccatgatccaacaacaaacaataaaaaacccaccaaaacaacaaaaacaaaaacaaccccccaaaacacctgaggaatgataaactactaatgtattgttctaaacatatggatacataaaactttttgaggaaaacagcagtttcatttaagacattttgtttcattacctggcagttccagatatcctttttaatctgaaaagaaatatttctcaacaggctaaggaaatccaatcaatgaatttataattacgtaatttattcttcaagtttcaccacaataagaacaaaatcaccattatcagaaaaataaaatcactcctagactgttttctgcattctgcaaagttaatgtgctcttttgttttcaaggtataaactcataaactaatatttatatattcaaaacaatggtgattcaaaactgccactcttcatgtgactagaggtcctataaaaacggaggtagttcacaactagatgatttaagtcagcctttctggtctttttcacttgaaatttatgagtctctataatattctttccagtttgaatttttaagtactaaagtgcctcaattatagaagttcataagcagctagaacttaatcagaagagtctcttggttggattggctgatggcagcgtaattttaacatttgagagtgtggcattaaacagatgcactattacattctttggtggttacaatggagtgtgttccaattagacaattatccatatgccaatcaagtggaaacacttgggcggaccataagcaggtaaataaatgctgtacctgacacatcttgatatttccaggccactgatttaatgggatcatttgtaatgctctttggggatgcagacttcagtatgtaatgggtctttctttctgacaaattcaaagagcattacaaatgttatttggagccctagaataagtgaggtcacatttccatttttacagatgggagaatcatgggcacatagagattaaggtcatgctgtctgggagacacctaccacttgcacagttcaattttcctacctcaacccgtggtttctatcctggcaatcacactgcactgtgaatttggaatggaaatcagaacatgccaaacttaaaaatcctcctagcaacgacttctatctaaacattcatcatttccacttaggagccaggcttgttacagacatgcttttgtgtatacttctgtgagcggtgtgtcaaatttgacgtccctttaagaacaacaaccccttccttgtcttttttcttaaattgtataattttgttaccaaggtgaagtttttatatagttaacagactatgtaagtttggttccatgaaagtcatagatgacagtgcaaataccctatatgaaatacatcagccacatcttgttgtaagctgaaattcacaggattgtgattaattcaggaatctttggcaggatagtgtggggttaggagaacttctgtgggatggaggagtaagtaccctttctaaatttaggttggtggtgggtcaggtaaactaacacaaggtagatagatatagacagtgactgacaccaacacacacacacacacacacacacacatacacacaatttcttttcttcttctgtttcaggatttccccagtgcttggctctttgtttagttctaaaacaatctgctaatatttattcattcattcctttagtcaacactgagctcctgctgtgtgcatggtactgggctgggcaatgtgaaagatacagaggaaacaacagtaaatagcctctcctctagatgctgggtcacaaaaattcttacatgtacatgataactaagtcaggacaatacaaaggactcttacaatggctataactagtatggtttccataggaatccaggagatttctggggatcagtttaggggtcaggagaatgagctcaggggatccatcttgaatcataacttgttccacttattggaaatgagccactgaatattcacgataatctgggaatatttgaacccacagaatgttatcaatttaaattcaatgtgttttttactcttttggttcagttttaataactgttgttccatctctgtaactttgctataaatcagatgtcctactcagtgggataatcctttaaggctagcagagtatcacctaaggaaatgagccccagaggtttccaaagggaattctcaccaaaggcgatggtgggtgtgactgcgtctgatggtctcatcccagcagtccttttaacatttgctctacgtggcaatacccatgagtgtcccgccccatcctgcctctgtaaccctgttgccaacctgatttttcccagtattttggcctgcaatctgaactccacctgtgaccagctctgccagatccctgtcctactgtagagcttgagatggaagtatacaccccttaatcccctttctcttggtgggatcctgttacatcccaccgccccacagcttactgtgtcttcaggtctccccaggactctccagaccatccactgctccatcaagttttggttctcactgacttcagaactctttaggaatgtcagccttaggtcccgctgatgaggtctacctatgcttgttttccatctgacactgaatcctgagctaatccctgattgttagagaaagtttgagatttaaaaattcaagtgaacattatcacaacctaagagcaaggctttgcctaaaggcaaacacatctaacaggatttctgacaaaggagagagcctgtctctggggaaggacaatcatttgccacctggtatctacaatgctcacttttctccttggggaaaaaaagaattgaactagcttgaattttcttgttacatgggcttgtaagactactcaagatctattctagtttaaaacgtcatctgcttccacctggggatgaaactgcactcaatttacactaaggcatgagggtatccaagcctatggccagtgtattaaccctggtgcccccctccctgcctcaggcatggtgacccctgggggagaaacatctcttggagagaactccaccattcagacgactgataacaggaatcctggatcatggaaatgaaattgtgttcacagcctaatatgctattacactaggctatacatatttaattccttgggtctttcctcataaatcaattcctctaggcctttaatctcgtcaatatcttttctgatattgaattttaaatgccattctcattgctaggcagaaggcaatctctcattcatgatgagatcaggcttcatttatagctgagagatggtgggagcatggccctgttccctgaccctgctgttaagatcctaatgtcagctagaccgcacagccgaggtgcaggcctgcctgggttgatctctgagaggtcaagataatgaaccctggggtcatgcctatcattactctgggagcctgggacagctatggagaggagtgagaaagctcaagtaagtgtttccaagggtctggcttctcatgggggtgcctgaggcatgaaggaccctgctgcaccctgacctggcaaggatccctgtggaccgagtaaggcatgagctgaaggatgcacactgtgtgcgtacatctgagcaatgtctcccagcgcaggggtgaagggagggcacaggctgtgtgttcgctaggggaaaagagggcatggaggaactccagagaacaaggacttagagctgaaaatgtttccaggttccctagggctggcctggaatgcagtgggatttcctctgctgcagagaaaaggaaaaaaatccaagaatctttgagccatgaaaaatctccaaagggaggagtgagtttttttaggacctcaggaggcacagagaggttgagaaaacacaggaagccatctgagatacagatttgagggcctaagtctgcagcaagtggcggggcaccaaggacggggcctgggctacctgccttggtgtaggagttaagcaggtacaattgtacaaaatgtaaaaacaataataaaactaaaggtgtatccatctatcatcactatgcaccagcaattctaagcaaaatcattgataaaactctccttcctcataacaatcttttgctgatctaaattctaattgttgccattactgttaagatttaataatatgtatgtaatcttcaaattagcatattctgttgcttaccctttaacaaacattttatgtggcaactgatttggaaaatttctagctttatacagtctgccccagctctctctcacacatgacttagctgcacacatttgttctgatttgagcttgctttggatacagtgtctccagcctcctgtagcactacatatattctgcatttctatactagattcaaaataaacaatgacagcacagttttgcaaagacgatgaactagaacttgagctacttccattcatcccacaggaccactctgagaatttttatgtttaaaatttaaaacaatgaaacatttttagttggcaagtgaaaattttagttcatatgtgaaatatgtttacgtttcagtatttttaaaattgaaaattttctttatagattgcttgctttaaaactaaaagacaaatcaagaaaatgttacatcagagacacaatacttgcctaaattgtgccctttgcatttggttttattaatacttatgatttactggacaattatttatatacagcaatatgttaactataatcaagaatcaaagttctaactgttaggtaaagtaaagaaaactattgaatagatagttgcaattttttccttttatcacactatttaattttcttactggcataaatatacatgaagttcaaaagaaaaaaattttagtctgcatttctttcttggccattattattcattccattttatgataattaatgaaaataatgttgtctaaatttagaggaggaaatatttaaaaaaggatcctctgagtgttaaatttcactaggtgcacaattatcaggcagccagtgcctgagacggggagagtcatgaccttggcctgttgggctaggggctggggagaactgtttcatcagacaagattttagagaccatttcctttgcttgaatgtacccctgggagggactggtgtgaaagacagatgcttcgtggcattcccataatccactggagttattaatcatgatatactatatcccaatatggcaacattattctgaaaagaaatatagtcaaggactggcaaaaaggcaaaaatgaagctgcatgtcggcatttcaaaggctagcgtgattagctccattatcagcttgctgtgcaagcttgaacaagctactgctctggtctcctcttttccccaagccttctatccttacaactgccaaatgaggaattattgatcattcacaaagcaagatatcaatgaatttcttgactacagaacacagtaaaggtagatgtaaaagtggtttggaaggctctaaaatctattttctcttctacagatgattttcttaacactgtaatttgcagggtcatctcaggttcccgtttttcactttcttcacatgttaaataaatataagaatacttaccagtgggatattgtatgactaaagaacatgtgttaagtatgtgatgctccttgaatgacaaaaggtgcccgctgagttaaatgaaagtgctgtcattatcctctttgcaaaaatggaaacactaagtcccacgaggtgaagtgacatttaagtcatatgagtgggcagtactggggattaatattcagagagaaaggtcggttgttcagccccagcctagccatgctgggtgcactccttcagcccatgctgaaaacataggccagccaacttgaattaacaccattcatgcaattcacaagagaaggtgtcaaataccttgctgaagtaggaacatgtatcagtgacattctctcccttgcctttgctggcagttcttctgcaaatggtaatccaatttgcttggatttatttattcttatcagttttgttttttgcaattatgtgaggtggtcatcacccatcctctgggcacgtgtacagttgttaatgtagaaatttaaaatattaacatgctttccagccaggttggcccatttacttcaatcaaataagaacttgatggaacagctgggtcttgcactatgccctgaaggcctacagaaatttgttctttctttacagattttataacctagtcatgatcagagattacagctagaaaaacccctatgggtgacttgtagccaaagacctgtggccctctttggaggtaccttttgcaagcgatctgggcctcattcagtttaaccactggagaaccaaacaataacttgttttagcatcattaacaacagatattaccatcatcactagtctctttggttgcaggtttaggaaagaagcttttgccttaatcattatggaataagaatgtgttggagtccagagagcttttagttgaatcttaatggtgagagttgcaatgatctagcctgttttgcagatcagtgaagagagaaaatacagctgaaggtctgatccatcagccatagatgtctgactaaggatggaaaactttattatggatttagaaggtctgtatcacctatattacttaactcctgataattgtagaactttagtgaagttaatccaatgattacaatattcccaatttttctttgttaatacaagtaaacatttttacaactaggagaatcacacatttaggagcagggtaaagagagaagaatagctctgaacttagcacatttaatctttaggtggctctggaacaagatatgtaaataaatgggcacattcatcaatcactaagggaagtgagagggagaggaagtttgctccttcccccaaagtttccaagttatttaaacacatttaggctggtctggaacccaacattttaggaatgtcagagtaactagaacctttggaggtctccaagtttcacctatgccctaatccagggtcaagccctggataaactggtgagggctgcattagacaggaacagtttccccataggctttcaaccacctatagcaactactgaacctctgaactatctcagatttgccctgtctttgaacttcagactctctgtaaggaaaaataataataatagcagcagcagcagcagaaaacctcaacaaatactgccattgtgaaatgtgccacatattcttaatacctgctgctgaaatctatctggcaaaatacaatacagcaccaccatcttgcatagactccaaagtgtagaaaattatcatcttaaaccaatctcctctgcttcagaaacattaaatatagaaagcattaaagaagtgagccgagttagaccttttgcaataaatggtgtcagcatggccatgaatgataacagcaaaaaaggcctccaagatatgaaaattaagagaaattagagccccagcttcacacttattattaatatccacatgcctgtgatgaagtgctcctctagctttagcagtccccctactctcagttggcaattgcatacattttaacattgcatgtgatgtttacccgtgaaaatttccaatcacaagttttgctgaagtcatctgaaagtccagctgctcacagtgatggcacaaaaaagatgatcatttgtgatatatgggtatttaagttttcactgtagaaatacgggagggataacaccaaggttagtgttgatgacttttcaaaagggaagaatagggagaccacgtttttagggtctgctggtagactttatgtagcaatctttttctgcttccagggacaatttgaaaatgtaaatcatgatacaaagcaagtgacataaatcagttgcattctagtccaagtgattatatgaggattgaaagagattatatcgggattaatctgggaaggttaaaaaaatcacattttgtcactgaggttgctggggataacctttaacaggataagaaagttcctttctattccaagttgttaaaaccttcatttttcttggttgttttagtttaaaatcatgaatggatatttggtggccatcaaaatgtttgtattattctggttttgcctgttaatgagatctattacattgatagatttttcaaatgttgaacttaccttgcattcctagaataaatccaatttggtgatttataaaataccagattaattttgcttttctaaaggaattataaatctttgtttataactgagcctggcctataattttttgattttaacttttaactgtccttgttttatttcagtattaagtatactagccttacgaattagttggaaagtgtgtcttccttttgtgttctctgaatgagttagttaaagattggtattcttttttctttttttttttttgagacagggtcttgctctgttgcccaggctggaatgcagtggctcgactgcagcctcgacctcctaggctcaatgatcctcctgagtagctggaactaccggcatgtgccaccatgcctggctaatttttaaattttttatagagacagagttttgccattctacccaggctggtctcaaactcctgggctcaagggatctgcctgccttagcttcccaaagcgctgggattacaggcatgagccaccacacccacccttggtattatttttcttaaatgtttggtagaacttgcctataaagcaattttgggtctgttgctttgatataaaattttaagctattggccaggcgcggtggcttatgcctgtaatcccagcactttgggaggctgaggcgggtagatcacgaggtcaggagtttgagaccagtctggccaatatggtgacatgccatctctactaaaaaaatacaaaattagctgggcatgcacctgtagtcccagctgctcgggagctgaggcaggagaatcgcttgaacccagaaggcagaggttgcagtgagccgagatcacgccactgcattccagcctgggtgacagagcgagactcggtctcaagaaaagaaaaaaaaaaatttaagctattaattcgagctttcaatttctttccaattcagttttgattagttattttttcctattgaaatttgtctgtatctccaaagttaaaaaattgtcataaaactattcctaatattcttatatttctttagtctctgttgcatctatagttataccttatttttaatactgtttttaggttgttctctttttttcttgatacatgttgccaaagattttccattttattcatcttttcaaacatttggctgtgttgatcttctctattgtatggttggttgctattttagttatttttattctttgtattatcccctctactttgtgtttattattttttgtttgtttatttgagacaggatctcactctgttacccaggctggagaatacagcggtgtaatcatggctcactacagctttgacctcccaggctcaagggaattatcccacctcagcttcccagttatctgggaccacaggcacgtgctactatgcctagctaattaattttttttttttttgtacagatggggtctcagtatgttgaccaggctggtctcaaactcctgggctcaagcatatcctcccgccttggcctcccaaagtgttaaaattacaagtgttagcaactgtacctggcctatttttttttcaatagaaattggatgcttacctcactgttactagttttttttcctaaaacaaagttttaaatttttcctttaagttctgctttagctgcgtcccacaagttttgatatattatgttttaattatcaattacttctaagtatttttaagttaattctgatttctttttgaagctgtaaaaatgatgtatgttttaaactttccagatatacaaaatttattttagttatttttggcactgatttctaacaatttagtgtggtcaaaaaaatacaataccactcttttgacatctgttgagatttgctttaaggcctagtatgggattaatttttgtaaatgttcccagtatatttgaaaagtatgattttctttatatgtcctacatattgagcttatagtagtatatatttacaatgttatggacttcacagttaggcctttacaaaaacttcctgaaagtgaagttaagtggcactgaagataagaaatacaaaccgttaggaaagaaatataaacaccagagagaagaggacaaggtgcacggagaatgagagaacaaaatcatggcataccaccctatgtttaaatgactgaaaaatgtgtaacacactgactcagcaaatgactcagtataaaatgtaaatcatgggtggaaatatacatatcttaataccatgaatgagaattccaaagctggccaacgaaagccactctgactgaatctgagtgatacctggtttaaaataaattaagatggtaatggtggtggagggcataaaaaatagaatgcagttgtctggtgggtcagcaggatgaattaagagaacaaaaggaagaagaaaatatgataatttatttttatctctttgaaaagtcactgtgttggtctttcatttataagcgctacttattacactcttccttggaaacttactgacaaagttcaaatatactttcttctttattttcttccccagtaaataaggctgttgtggctatttgttaaaggtgtgtgtgtgtgtgtgtgtgtgtgtgtgtgtgtgtgtgtgtaagagagagaggggagataggaatagagacagagacacagagaagaaacagaaagcgcaaaaactggaaactggagaggtaatgagaggcaattataaaagaggagatagaaatatgtagagaaggagagtcagagacacagagagaagaaacagaaagtacaaaaaccagacagtaattaccagatggaagaagctgcacatagataagaacttgaccatgcagggtgtattcactgatcaattgagtgagatgggtggtctgtaaagtgaggaccagattgggcactaacttgtttaagtttcccttgatgactattcagggtgctttgttaaacagaggagaaaacatagtctttaactaaccatctaacatcttggaactgaattcccaattccacactttggttacaattccagacactttaactgactaagtttggctgttctattggccagtatttaaaaatgattaacactctatgtttatatatatatggagaaaaagactgaaaggctatatgtaaatgttagcaatagttatatctaggtagtgacattatgaatgatttttatttccttttatatggttcttttatgtttccaagttttgtgcattgagcataaattcttttgtaaaatgaaaaaataaaacaaaaatttaaatgacaaaccgagacccaggaaaactgctactcccacctatatttctcttcctctgtgctttctcttagtcatataagaaggattttttttgccgaggcaggcagatcacctgaggtcaggagttcgagaccagcctggccaacatggtgaaaccctgtctctactaaaaatacaaaaattagctaggcatggtggcaggcacctgtaatcctagcactcaggaggctgaggcaggagaatagaatagcttggacctggtaggcagaggctgcactgagccgagattgcgccactgcactccagcctgggtgacaagagtgagactctgtctcaaaaaaaaaaaaaaaaaaaaaagaggaattcccccctcttcttctttcttctttgttccaatgctgtatttctttgtccccccatcaaatttctccctgcattttcttcactgctttcatttctgatgagaaggaaattggctggtcttcctaatcctgttgcctctcctagccagctgcatagaggaaagccctggagcatgaagacccccaactgcggccggagttgaaatgggtaattacatcagtctggctgggagcaggacacctgctatagacagccaaccatgttgctggcagggttcagggcttcagtgtgaatgagtcggcttcttggcattggtagactagaaagaaatgaagtcaaagccagaccacaaggaatcattttagtgtccatagctggagggagaaagatgacaatggtcagcgtggtaggccagtatatgtctgcagcaaaagtccgctttgatgtattacatttaagaaaagatccatttcactataaatctcgtactcatcatgtgatatagactgtaagtcaggaggcagtttccaaaagaggcagtgaaagggaaggtcattcaaaggtcatttaaagactgccaggaacacagcgttgggaaaaggagagttcctttatcctgggaatggaagtctactggagagtcaggatttcccattgcagacatcagggaaagcagcaaaaagcagaagtcaaatgattttaatagtctgcagggcaatgccattatttttgcccctggctcctacattgatttgtctgctagcctcattattttgagaaggaatgattactaatgaggatgcatttgatgatcaaattaattaatggcagagcaggataactaatgatgagatgaagcctctcatagttaaattttattagggcttctcttccccttcccagaagtgaattcagagatttattttcatgattcaaatttaataaaagctgcatctatgttactttcctttcgcaggttcttgctctgctaatgcaaagaccaaattaggggctatgacacagagtcagaaaataggcaatgggtttttgccagtaatattttagcaatctatctccaagcatatgaaggagggaacttcttgtcttctgctgtcttgatgactgcagttctgaagcactgctttcagggtacactctggaaagccatggtgtggggttatagagggaacacaggggctcagacaggcctaggctgcagttctgactctacatggtgtacctgtgccctgggtcagtcacctgacacctctaggtctcagtttcctacttgacacactgggacagtcacatacccctgagttgttgtgaggaccgcataaaataacatgaaggtgcttttgtgagttaactggagagactggccttcctgttgtaaggggcattggagtaaacagcacaggccaccctgtgtcaggaaattatgacctagacttgtcccgactaactctgtgagcctgagtcttcttttaagcctcaacatcttttcatattttcacctggaatatggcaatgacagttcacacttgtgagtagcttttcaaaatgtcctcacgtacatgatcacatgtgatgtatgattttatcgtagcaagcccttactgaggttggaggcacctggtctccaggagaagaactggaggtccagacatcctgagtttcccaaagaagtacagaaaacaaacagtgaagctgaagtcacattttccttctactagttcagtgttttcatttcattattcatgcccttaggtggcatcagtacggcttatcttcttcctcatcttatgacctctggtcagtgaagacggcaagatactcagtgggccatcctcactcaaaactgctaaaaaacatataaggaggcttcctctcatcttcatttttagtctttgtatcttgtccagaatcaaaaggaaaagtgctctgaaaagtcccaaacctcttacagatgtcatgtgtgatcctttcaaacaggtagggctttgtaatgtaaagccctgggccgagaattggagaattggtttctatttctggttccaaatggagccaaccgttccttcaagagtctcacactgaagtgagatacttaccttcttaggatgtaccaggagtgtaatctgcaaatgtcagaaaatgcacacactgccagcaggaaccctacaaatgaccttgaacagcctaaagaaaggtgccaaggaattatgaggattatcatcttgtggcctgttattataatgcaccatcccaatattcttggccgaggaatggataaaaaatgaaattacaaaccctggaatagttaaaggaagaccatggtggaccccaaatttggcaactcttgtgaaccttgatgtttaagtcactaaacctttttaaagccgtgtaatctgagagatgtacatgttttaagatttttctgattctagtaaaatgtcggtggcttttaatatgaatgtgggaaatgtcttctgcatttcccacagccatattctattctatcctattcagaaagaaagaaacttaatctgggttgtcgaagaatcagataaacatggggtatgtctttgcagccacagcttgtaaagactccaggtttttatatgtgtatgtctatttatacatacacatatttattttttgagctttttaaagctgaatatttgactacttgtacatgagagtctaagagaaaactcctttctctacactgttaataagattttcttgccctgtccagtgatactgaattattttctgcactaatgtataatctgtcatatattaaagatattaggatatcattcttcctgaatgagccaataaccagatcattgtgtatgggctattccttccttctaattgaacatttttgaggctcatgaactctacttagaaggtagatcctcctgatacattgcaacttaatttccaaactttctatctttagtttttttttacattctacatctaagtatttacatctttcataatggctcttaaaattagtaaagtttcaggatacaataactgtgtacaaaaatcagtagcacttctattcaccaacaacatccaggctgagagtgaaatcaagaatacaaccctacttacaatagccacgaagaagataaaatacctaggaatacagctaaccaaggaggcgaaagatctctacaaggagaactatgaaacactgctaaaacaaatcagagacaacacaaataaatggaaaaacacttcatgctcatgggttggaagaatcaatgtcataacaatgttcatactgccaaaggaatttacagattcaccactattcctatcaaattactaatgtcattctttacagaattaaggaaaactattataaaattcatatggaaccaaaaagagccccaaacaaccaaagcaactctaagccaaaagaacaaagccagaagcatcacactacctgacttcaaactatatactaaaaaaccacagcaaccaaaacagcatggtactggtacaaaaacagacacctagaccaatggaatacaacagaaaactgagaaacaaagatacacacttaacaaccatctaatatttgacaggactgacaaaaacaagcaatggggaaaggactctctgttcaataaatggttataggataactgactagccttagacagaagattgaagctggactcctaacctttcactgtctacaaaaattattaactcaaaaccggtcaaagatttaaatgcaagacctcaaactataaaaatcctagaagccaatctggaaattctcttctcgactttggcattggcaaagattttttggctgagtccccaaaagcaattgtaacaaaaccaaaaatagacaagtgggacctaattaaactaaagagcttctgcaaagaaaaagaaactatcaacagagtaaacagacaacctacacagagtgggagaagatattcacaaactatgcagctgacaaaggcctaatacccacaatctctagggaacttaaatcaacaagcaaaagccaaataaccccattaaaaaatggacaaggcacatgaacagatacttctcaaaagaagacacacaaatggtcaacaaacatatgaaaaaatgctcagcatcactaatcatcagagaaatacaaagcaaaaccacgaagagataccatctcacaccagtcagaatggttatcattaaaaaagtcaaaaacaacagatgctggtgaggatatggagaaaagggaacacttatacactgttggtaggaatataaattagtaaagccactgtggaaagcagtctggagatttctcaaagaacttaaaacagagctatcattcgacccagcaaggccattactgcgtgtatacgtaaaggcaaagaaatcattctaccaaaaagacacatgcactcacatgttcattgctatgctattcacaataggaaagacacagaagcaacctaggtgcccataaatgataaatttgataaggaagatgggatatacatatatatatatatatacacacacacataccacagaatacaactacaaccataaaaaagaatgaaatcatgtcctttgcagtaacagggatgtagttggaggccttaatcctaaacaagttaacatagtaacaggaaaccaaatactgcatcttctcaattataagtgggagctaaacactgagtacacatggacataaatatgggagcgacagacactgtgggctgctataggggagagagggagaagggcacggctgctggatactatgctcactacccaggtgatgggatctgtacgctaaacctcagcatcacgcaatattcccatgtaacaaatctgcacatgtaccctctgtatctaaaatagaagttgaggctgggtgcagcggctcccgcctgtaattccagtactttgggaggttgaggcgggcagatcacttgagatcgggagttcaagaccagcctggccaacatggtgaaaccccgtctctacaaaaaatacaaaaattaaccaggcgcagtgacacacgcctgtagtcccagctactcaggaggctgagacaagagaatcacctgaacctgggaggtggaggttgcagtgagctgagatcacaccactgtactccagcctgggcaacagagtgagactccatctcaaaaaaataaaaataaaagttgaaaaaaatttttaaaagctcttagaatacaatttatcattaccaaatgttgaatttttcttttaaaggggtttctctttttccatttttcttgtccttctatgcttgtgcattttcctttgaaagcggtttttaactggagaggaagaactgtttgttcttctgcatccctcactacttctgcacatccttcccatccctgtgtctggaacggactctactgttctgtgtcctgcacatgcatgggggcttaggcgtgccctgctctggaccattagtcctgccaccttctcttctagaacagggaaacagaaatagtgtggagagcaagttcactatctatctttgttccatatttcaacctcttcatgtcaccttttcctatttgtcttcctttctcactttcagaaactattttactttgtgcatctgcctcttcttgctgattcagctatcttcactccaaagtgtgccaccttaagttcccttgtccttcctcctagacattcatgaacctgcttgctgttcctcctttctctatatgtttccgggcagccagaacaatttgcaatactctccatgcttcccactgcaccacttccccctgccccaccccagccacatggtaaccaagaattcattcaaagactgggttaaaggtaaaggcccccgaaacaggctcctgttcaagatgtcagaggcaatgtatgtgtttgtattttcttcctccagagactcaattaaaatatctgtcaatgaataaacttacaaaaacaaggagaaaggaaagtgagttccaggagttcctagtgtatgacaggttctggcattcaagggatccccacatctccttaaaatgaagcctgcctgtcaaagagctcttggctggccactgcccaggagaaagactcggccacgcagcagatccagacacagcaatgagcaaagccacagagcttcacagaaaagcaaaccaagccctccacacctaaatatacacagactgccagccatcaccttgctcatgaagaaacctgtacataaaagagagagactgaaacacaatagctaaacaactaatcctggagtaaagagagatgattcaggaaccacaaagatcttaaaaatcctacttagtattcttaaaaagatttgagaagatactgcacccataaaatacgaataagattgcatgagaagataatgattagaggacaaaataacctcttgaaaataaaataatatgattaccaagcagaaacttcaattggaaggatcaaagataaagttaaaatggaagatactaggaaaaagatgatgggcatggagcgcccacctattaggtccattatctgactggtgggtatttcagatagaaattaaaaacagaagacaaaagtgaaaaatgatcaagaaaaaggaaagcctcctgtcacaaactctggtgacactctgtgctcctgcctgcagccctgcatttgctcagttctctggagcactaccttctgaagttggctgggagcatctggtctgctgcacttttgaggctttccacaatttttaagggacaaggtttaaaaaaaaaaaccctataaaatattagtgaatatgctcattttatctctttccctaaagctttctaatcattaaaagcaccaataatgctaccacagcctccttcaccaccatagccaccaacacagccatagccaccgttgccactatggccccttcaccaccatagtcatcatcctcaccataactacccttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacatgtgagttttggggaggaattgagtgcaagcttttctctttctctaaaaaaaacgtacttactaagcaactaaatagtttaaacaagattgcagaagacatgctgaacttacccaaggggtcagatgtaatcactatgtttaatttcaaaaatactttcatttattccttagcagatattccaaagtctgactcttacccaacatctgacaaaactaactggggttactttgtattttaggaaagtagtaatgttatatttcttcatcttccataaaattagtctaagtgggtgagattttaacaatgcatacacagaaaatcacacatatgttctactttgagtataaagaaaaaaatgcttgtcacttaatttctaaaatgcttttgatcataatcatcctacttttcccattttttttttcctgatcttcccttgctgaaagttgtcaagacagtggaccaggcctgcaccttactaatgtcaagctaagagtgtgagagagactgctccacatgggccactggcttgctggcctaagacagctggtcttcagactagatttaacactgttcaaaagcatcggcttatttaggaaggagccctttgacataatcatcattagtcatacgcacttttatgatcagcagtttttaatggtatcctgcagttatccaaatatttattagtcctgtcaatatgatttacacaaggcttcaaaaagaattctgatttttaagcggattattaaaaaattatgacatgttgacctatcctcatgaatgaaaataaaaatactgcaaatttgtgtgtaaataaaaccataatgagatatcactataaatttactacagtagtgaaaaaagacaaactgaccatgccagtgctgcctgatgaggatgcagaactggagtttgcagacagtcccgagggaatgcatgatggtacagacgcttgggaaaagagtttggcggtttctctgaaagtaaaacacacttgccatatgacccaacaatcacattcctaggatttactcaagtaaaatgaaaaattatgtctacacaaaaagcctgtaagtgaatgtttatagcagatttattcccatttgtcctaaactggaaactatccatccactaactattgactagacaaacaaaccacagctctttcttacggtggaatactgctcagcatcagaaggaatgaatgcctgatacgtacagcatcatggatcagtcttagattcattatgctaaagaaagaagcccaactcaacaggttgcctactgttcaattccccttatatgatattctggaaaaataaaagctataagggtagaaaacagagcagtggttgctgggagtggggctgactcaaaaggggcaagaggcagcgagtgctggaactgatttatatattgattgtggtagtggtggttacgtgactgtatgcatttgtcaaacttcatagaaggtatgtctaaaaagaatatatttcattgtatgtaaattttacctcaataaacctaacgaaagaattcagtgtggtaacctgaagaaaaataagagtttaaaatatgtatagtctttacttgtacacctaaaagtacaaatgaaagtcaaaagcctcactatccctgtggcagagacaggttaacttcactgccagtttaagatcaggtaaaggctaccgtgttaccatggatacaagctcttattctcttttgtatgaaacctttcatattattaaattgtgactcacatggtgcaggggtaaactcggaaacttccagacaaagtcacccaagagtttttccatgttaggaaccctgcccatagtgttttcttcatgaacacatgcaaaactgtgtgatgtcagtgaacatatccttaaggggttaaagaaagaaaggttagaaaatttttggctaaactgaaggcgattccaaaagctgtctgctagtcctaaggtcattaaggctctttctttttttgttgtttgttacagaaataatttcccaaacatagactggaaatggtgacatatgggaggctgacccctcctctctctgtcatctttcatgtgaaaccatgattttctgatttatacagtggatagtgtggagattgaaggcaggttttaaagtcaggctaattctttgtggtgggattcaaattagcaaattgtggtcatttattcatacaaggtagatcatgatagaaacaagactttaaaaagcacttatattttaaaactctgtaaaagatgttctgccacagagatagccatacaccgcctaacaaccagtaaacattaacatcatagcagccaccggggacccagtgctttctgtaggttaaagaggcacacctctcaggccttggctctcccgctccctgtcttgctcttcatgatccaggatcccacacagcccagagctcccataggcaccatgctaggcttgcctccaggtctttgtctattcattccctcatttgacacagatattttgactgtctactacgtgtctgttatggattgaattgtgccctgccccccagccccaaatccaaatgttgaagtcctagcccctactaccacagaatgtgaccttatctggaaataagtctttgcagatataagtaattaagatgaggtcatcctggagcagagtggacccctaatcctacatgaacagtgtatttataaaaagcagaaatttggacacacacacacggagaatgacaagggatgatgaaggcagagagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgtttaaataaaaacaatcttttttttttcagaaaatattgattggatttgtatattcagagggataatttaaaaatacccatgatgataatatatgctctgttattctaaggtaactcaaaggcccaaacaccttaagaatatcaggtaccaattgacgttttcagatacaaatctgactgtgaatctttgactctattccctcactgccaacagtcagattttcccctcctgtcgacattttatatcccacagtacctgttccttttccctactccaaagccctcaactttcatttcctttttaacaattgccataaatatacatctttaaattcagtatgccaggatgaggtctggcactcttcaacaaaaacacagctattgccctgtttctaaagttatttatcccccaaaactctgatgcttcatgtattccatcaacaaacacttcttaaacacgtaatgtgctcaaagaacctgactagatcctaagtgtaatacagaaaaagtggaaacaatataatttacatttacactaaccttgaagacagacaaacaaactgcttttgtaaaatcagttgtcgtgctttgaagttaaaagttctaagattacaaaatgcttgtatcatgcagggatctgctaggtatttgccatggggctatatttcacatgcagcctttcaatctcctaaatccaaatcattttcctttatttcctacctccagggtgatttcttcaacatattttattggcttggcttttctccagattctacccttccacaaacagtcattagcacttttctgtcctagtaacatagctttttggttgtcatttcttctccttcaccctttccagcacacggctgcctttccattttcatttaatacacatatctctttctctcaaaaaaaaaaaaaaaatctgggccaggtacctgctgcatgccttgcatggtttgctgcagaaactgcagttgctggtccttggtgaggttttcttctgttcggaaaagctgttctttttcttgtttcagcagctccacctcattcctgtaggcatccagctgccagcggagactgtcattctcctctttcagagcgtaggcctgggcagccagggctgagggacaaacagaacgagttcaggtgagctaccttcttgcttagcttgaggaggccttctgtgggaaagggagtctgtcacccaagttcttaatgtttgtaccagctcagaaataaaagcaaaatgccactccctgggcctctcttttgtagtcggtatgcatcacttctctcggaacttttatctattctgtttgtcctgtcttacatgtgaatgtttcttatgggcacaggattaattcctcccaaattctcatcccttgacctctccctcaatgctagacaccctcacagacattggtatgtggtgctaggtggtgacaacatttagaattccaggcaacaatcatatctactaaatattgtcttccccctttctacgggattgcttagctacttggagggctgcttgctttcaaataatcagcagttccacaggttgagacatgcggcagcatcccaggggagagaggaaattatatgcacaccactccttcctgctctactgctgggacaaattgcacagattgttttcctccaactcctatcagaatgggaagctagttccatctgtttcaccaacagattaaaactcttttcctctacaaggctgagtggttactctaatacctctccctgaaaccccaaattctccacatttagattcagacttcattcatatgtctatcttattaagaaaccaagacagttaactcagggtctcacacatctcaaggcttcagaaatagccgaaactgaaaaagaaacaaatggtaccaaacaaagattgagggtagggaaatccctttccctagtttctaccttattgcttaggggtctctccgaaaatcaacatagcctgctgagcactcataaagcactggatcaagagctttgtatgaactcactcacttcatacccccaccaagcctgtgatgccggtgctggtcttatgctcatctttacagatgagaaaaatgtggcacagagaagttatgtaactcatccaatcccacaaagtaagtagcagaaagccttcacacccaggctgcaggctccagagtctctgctctcgattaccatcggtccatgtgtttagttcttaccaggctgttcaaaaccagtctcacattcccccaccaactctcccaccactctccctttaatcttccccctcacagaaaagccattccccacttgtgtaagcaagagaaaagtgaaagaaaatttgaaacgcttgttaccagaaacttcaaacatgtaacttccagtagataagggcacggtgtggagcccactgcacaccaggtcgtcagtgcatgcgcgtttccagcccccgctccccgtgtcagaggaccaaatcaaggtcgcctcctgagtgttctacctgcacattacagttccatggtgataaagctttactgaggttctctgagaccacagtgaattctctcctcaaatatcaaatgtcaaattatgttaataatagttttatagttgagtgttttacagtactccatcttgcaaaatgataatctctgtgtagtacacactgaactactaatcagacagaacatgcaattacccagaaatttccctacctcaagccagtagggatcaattacttaacacgcatttacttcatatttactgtgctcaggtccgtgagggcatctcagaccacaaaaagaggagacagaatacatctcttctctcaaagagcttaatctagtagaaactgacacatttaaaaagaaactattgctttcaaaggaagaaaggatagtgtgatgtctggaatacagcagacactcaataaatgttggttgaatgaataaatgaataaataaatgagtcgagatgcatgacaaaaaaatgcatcctataggagttcagagaagagaaataaaaattcagactgaaggaataaaagagggctttggaagatgaaaaccccaagaacttggaaaggatgtctctcagtcagaagccagagcataagcaaaagcccagatatgaaaatcaaaggtagaacacttggggcaagaaggagagaaactcgaccaaaagccaagtgtttgcctggaagcagtgagagaaagggaatccacgtcaggtgatgggagaagatggggaaggttaggttcaatggagtggccaattgagaaccactgacagcgcttggagtagtggaaggacatgatgaaattgggatttaggaacattagtttggcaatggtgcatggaatgaactggaggctgaagagaatgaataaaggagatttcatttggtgtatgtgtgtgcaaaaccaaggagcagccacttttacagttttcagagacctactcataaaatcagaaattatccagcacataacccgcagcatgagccagtgctttttaacattgtgcagcccagcttcagatcttgtccacaccctgagataccacctcctgacagctccgtttaccaagccataaggaaatggttatgaggattcatttgtgagagggatgttgtaatagggcaaaatcacagaaaatgcaaatgatgaagaaagtgttggcactgcataggcacattactacatttagtagcattcaaagacacttaagtcatttccttaggaagctctatttggccctttttcaattcagagtggcatttttattatcataactgatagcaggtgtttgtgaagaaatcgattagtacgcagggatggaaattacattttccaaatgaattgcatagtctgcaagatatgctgaaatctgtatagcaaaatgcaagcagctataaagcatgtgccaacagcattatttaaataaattatctgaacataaatacatataggaaagtgtaccatccattattttaggggatctcttacaaacctatggaatggtactgctgagagttcttattcttggctaagccaagtgactacagtgcctgccaagcagtatataatattgtttgcattcccggaataggaatgtgatatcatcatattaaaaaaacccacaacagctgtaattcccccaccaaaaaaaaaaaaaaaatcaataccatagcaaattccatcaacatttttataattggggcacataactgatttacattcctgattaaatgatttcaagcttggtttttacaaaaaaattttcgttactcatgtggcagcaagtagttatcttctaaagggtgagaaattgtatattgactccacttagcttcaggccacctgtttgtaaacaccactcagtgtcatactgcagccctgaatctattcctcagacaaggctgcctggaagaggctatattatgtttcttgggccagagcgctaacagaaaaaaaatcctaataatttctgacttaatataacttctcagtatattaaaaattcagaaattggaaagggaaactttttatttctctctcttctctttctttctttctggaatactgtactaaattaaagagttttgaaaaaatgtgtcatcaagcttccataataaaatttaccttatgagactgcacaatgaatccactatccaaataagtataaggattaaaaaaaaaaaaagtacagtgtgcatctttcggtaggaattcctaaggagtgcaccgagtgccaataaatggaatatgtaagagacaccccatgtggattaccaatttccgataataaaaaaagaatagaattagacaccttaaatgtcaaccggactgaatgtgattaaatattttgttggtgattttaaaggcactgctgaatctagtggtgcctctggattaccatcaattaattcaccagccacccatttatgtatttattaagaaaacatggtgaggagctgtagcattcacaagaagcttaaggccagcacagtcacccatttctagttactcagtaatttagaaaaattctgaatactggaattttctgattggatcaaaaatgaaataataaaattggaaaaattttgctaggcaagattgttatacttcaaaacttagcactagactaaaaaatgaccaaagtgacactaatgtatgaaaatcaatccaaaggttgaacggcactgctgaagaaaaggcttaaaggtattgcggcatcttgttatattctttactagattctatataaaccattattctttatattaattatggtcaaagtgacctcctcttctgtctcctgtcttactgtgtttccatgggaacagataatgccatgcttaacttctttaagtaaataatctggagaaagccttgaaatctcttttaccagcctgagccagcctcagaaaaatagttagcaatatatgaaaaatgtaagttgttttgggttatgtcccagtaagctgacagtctgttaatatctttttcatgctcaggcaagatgtaactaaataataaaacattttaacatatcgtttctaacaatatctgtgtttctccagaactcttagtctttgtgtgtttggggaactctgtgtttaacattccccctccactttgccagatgtcctcctgaaatgctggaaggacgctgctgaactgtagatttccttcccacatgcaaagaaagtctttttcaagaatttcattggctgctacccaggaaggcagttgtaccgatagcccctgaacacaggagggcagaggcaggctggcctggcaaatgtcaccacaatatctgtgtgccttcaacggctgcctcctcagccacgatcctgcctcctgctccactaggaaagggagctgtagttatggcccagtgacagggactctctccagcttctatctgcttctctgcattctgaatcttcttgtgaggtgccttgaggcctttagaagctattctgtggcagagacattatcacgctgtgtactcaaactcatgcttctctttgtatagagcagtgttgctcctgagaggtgactgccctagagggtgccatgtgagcagtctcatcaatggagtgtgagggggagtgaggatgccttctgcacagtccctcagtctctgcctgctgctggaataggcttgggtctctgagtcaccacatggaggaaaggtgcccacaggcccagaatatctgccttggactgttgtgtgcccaaaaagtaacacttttttttttggttaggccatctttatacagcagctggtgttactctaacccagtgttctccaaacattggcctgcattacaagctcctggcgggcatattaaaacacacttttctgggccctaccctcagtttccagttcagtttgtctgggaggaagcccaagaattagcattcttccaagtcccccaggtggtgctgatgctgctggtgcagagaccacactttgagagccactgctcagaccgctgctcattctatcccgattcctaaactggggttgtggttggcttgtttggagaaatgcttctgaaagaaccacatgcttggcttgtcattctggttttattccttgatctccttttgtatgagccccgactccatgttctgcacctgggaaggcagccctgttgcatccctgtgcccaggtcccatgagctcagcttgccccgtgccctggctatctcctatggaagatttgggcaaaaggcacagtcactattctgctttcttcaaataacagtagcagtaatgggaatagcaacagtggtagtgacagctaatgatttttatgtgccaggcactgaggtaagcatattctttacacagtatcctttcaccatcatgaaaacatgatacagtcaatatgattattatttctattttccagatgatggaagtgagtttatgggagacagaggttgctggttggaggtaaaaggtgtggctctaggactatattcctccatgtaatgccaccaggctagcttagctccatgtaagtgccgcccatcccagagaaaggagtaaaccagggaccctactgtagtggctagtttgctcctaacagaagtaaaacattcaatttctggctctatctggggagtgttctgctggagagagactctgctatgaaagcagagaggatgatcctgttttaaaataaacatgcaggtattttctgcaggacaaacttggggatgatttatggagaagttaaactcactcttcaggaaatcttgaggcctggctggaaccacttagggatcctactttctgccctgtgtccctctcctctcaaacggccacactgatacccactaatcccagagctcaagagcctgagttgctaataatgctttattgagagagttttgtccatagacccatgctgatctcaggattcccaaagatccagtatgagactattcaccccatccatctgaactcacctatgtttgatttttaaggtgtctgtgccttcagttagaataaaggtgacagaaactcctctgcgttatgctgacctcccatgaactctgtcccctgagtctactttgcttgggctaatgaaggccaaagacaaggaccagtaccatgtcagaagattaacagaggcttggggtccttcatcattggtagcctcattctcagtggctgctgttgccatcagtgcctcccagtggccaggcacagagctggaaagtatcctaggatgacatctgccaacagccagtctcctgctggagagcctcttatggtaccaacaaagtacaattgatctgcttttcaataatacctgtatcaccactgatcaatcttcctcaaattgctcacggaaatttcttctgctacatttttgcaggattattattattacaacttagcattgacataacatttcatatgtgcagtgtgtattcgaatctgcacattagctattattagggaaagctaaacagaagcacaatgcagtgtctatttccatctttgtgtgaggccagcggaataagggtaatttcgggagtgcagggtaagctagatcctgttacgatgatggcttaaatgtgagtctggaggcacaatgggcagcaggtgactcaggaaaaaaaaattctctgctccttcctccagagagctcttcctgaggaagtactctgcaccagcagcagaactaggaggtgctgctgggctgctgccactatggagacttcacatcatgcctcatcacttttccatttacattactatcctctgctccgacccaaaaccatccccattttcctcagaggaaaataagcaaaggaaagagacatgttcacttcttgcaaaagcaggataagtctgtcatttaaaacactgttgaaggatgctctgtcaggtgaggatgcctttagagtcctccgggaaacacatcagaagtgaacgctgcaagcatgagctgagctccctactctaagccaagccggggacagggcagggaagcagagctctcagcccctgcccagcctggcctgcgcagctcccagcccagccgcaggaagagctacagatatggaacctggtagaaactggttagaagggctccaggaggggccatcctcacactgtgtagtgggagtcaaataagggagagaaggcttctggctggaacataagagctgggggaggctctttatggaaggcagtggttgagctcacacattgaaaagctgaaggaaagcagagtgggactgctgcacagtggacactgctttaccaaaagattcggcgatctccaggaggatgtgccatggctatggagaggcgagcaggctgcttcctactgagccccaaggccaggcaggagcatctcaggagggggcacttttccccactcttccttttcttttaattcgattttagttttctttttcactttcagtccctattttgatttccaagattatagggccatttaaaaaaaatcttctaaaggctttaaagattcttttttaggaaagtcaggcttagctaagccaagctagacaataaaatgacactggctttcaggaattgtaccccctcccctgcagacagtgcacctcccttgggtgtagtactccaccatgggcttggctctgtgtgacttcatcctaactgacagtagttggtcttggccaaagacagaaactttaaacagcaatccttccctccaaaacaactcctctcattttctcaccaatctacagtataaaagcagtgatctctttttcctcccatcttacaaatgtccttcctttttaacaagtggtcatttctaattttcatcaagaaactttccccttaagaagtgtatttcccctctcctgctctaccctctacatagaaacacacacacgcacacacacagttatattagtatttgaattggtgcttctaccatataaaacacatccacactatgaaatgtgaaatgatggccagctcaaacctaaagtatatcttctcagttctatgcattgctctttgcaaggagtagcatctttttttgtaaagtttttattttatagtgccaaatacttgcaataatgggttgaacagaaaactttttttgaaagttacttccgccttaggtaaaccctaactatccagactagtaagtgggcaccaagacttcacttttatgcttgggcaatgactctgcttgggctgtctctgagcctcctcctccccactgttctcattaccaacattgaaattgacttatgaacacttacttgtgtctggcaataggatagaaagtatctgcatcctctctaaatgtataaccaaggtgggaggacccagtatgaacaggtagctggcatcttgaggtatctgtaccactttggtatctcttaaatgagaaacctgggactcatcccagatgttacgaatctgagattctggaatggggcccagggatgtgcctttcagcaagtttctagggtgattctgatgcatgccaacattttagagccacctccctggcctttagggaccaggtccccacttcctaatgctttcttcatgactttcttctagtcttagatttctttcattagtttttcatatttgctttctttcagccttttccaacagctgaaaggaccttctctcctgcttttacaacccaacacagccttctgggcttctctgcctctgccatgtcttctcacattccattaacctatcggcctgctccttgctgaatgctacctcctgcctctccaggaatgacactgtgactgaatgcttgcgtaaatcctacaggcagtgtctccaaaacacattgtcctcaactgctcgatgttgttgtgcattacttttctttgcagccatatgtctggagaaagtttctgctatggcaggcttgtggcttgcacccaggagaggccaggctgaacctctggaactaattgcccttgaccgggccccgggaacagccttttcactgtgggagaggaggcccctcccatgtacacatgcttaccacaccagtctctagattcgcagaggcttttctccttggcgagtggccaggcatgcctgcttccctctctcactgctgacggatgagcaaacagttcctgtctattctcctagaggtagagaaaggcagagactctgtccttggcttgcatcaccactcatatcaggccaccctccacactttgccctcccttttcaagccgcccttttttccagtgaaccagaggatactccaaatgtgcccgacacagacctgtgaggggacttctccacctgggtctcacacgctccacttaaactacctccctctcacttctcctttctttgctcctttatcattgcctatgtcagtcacttcctgtccactacagatttttatactttactccatttttgttttcttctcattcccacattactttacctcacctcaacccgttttgtccttctttcccacctaataggtgggaaaagaggtaacctttctcacatcctcacaaaaaaagtttctgctttgttcattaaaatgatttgttttgcatttctggtgagtataatttttcaggtagcaatattttattcttaccagtgcctccttaaaaagcctttgcaagtgctgaggtgccagttaagcactatatgacagccatcatcctcacattacaggccagtggttttcaatcctttgtgcagcgaatcacctggggactgttttaataacaccgatgcctgggcattaacctgcggccattggtatgtgtataaagtttcccaggtgattctcatgtgcagacggggctgtgaaccacacattcacaccttctgctctacaccagcatcaactctccacattgccacagtgcctggtatttgcaaaatgccacagaatcccttaattgtttatttctcacagtcttattgaggaactctcaggatgagcctcatgtcattgctgagaaagctgaggcttggtgaagggatattatttgccaagccatgccagaaataaaaccaaggtacttcaagggccctctgacctcatctgctcaaagttactttttttttttttttttttccagagtctcgctgtcacccaggctggagtgcagtggtgtgaccttggctcgctgcaacctctgcctcccgggcttacacgattctcctgcctcagcctcccatctagctgggattacaggtgtgtgccaccacacctggctaatttttgtatttttagtagagacagggtttcactatgctggccaggctggtctggaactcttgacctcaaatgatccgcctacctcggcctcccaaagtgctgggattacaggtgtgagtcactgtacccaggctcaaagttacttctttactgtactcactgactctaaactccccctgccaacaacacttgttctcactcatagaggtccctttctcagagccattctaacactcttaccacccagatgagcctctcttccaaagagagtatcatagtgagcttggcagtgcttagtaaggcccgacagtggagaggaaacgcagaaggaagccaaggacttattttcggaattctcaatatttcagtgattcagatggcttcagttcacattcttcaactggacacatcatcacttctttttatccccagagttcgagtgccacaaaatcttgctttgacaaactcagcattagtcttggagtccttgggcagggaaaatgcatgtattttataaactgtctggatggataaattacagcaatttttccctgggaaagagttgttcagacatttaaaccctctatatattgagcatgataacctttctcacatccccacaaaaaaacagtttttgctttgttcattaaaatttgttttgcgtttctggtgagtatagtttttcaggtagcaatgttttattcttaccagagcctccttaaaaatcctctgcaactgggcgtggtggctcacgcctgtaatcccagcactttgggaggctgaggtgggcatatcatgaggtcaggagatcgagaccatcctggctaatacagtgagaccccgtctctactaaaaatacaaaaaattagccaggcgtggtggcacacacctgtagtcctagctgcttgggaggctgaggcaggagaatcgcttgaacccgggagaggttgcaatgagccgagatcacgccattgcactctaccctggtgacagagcgagattccatctcaaaaaaaaaaaaaaaaaaaaaaaaaaagcctctgccagtgctgaggtgccagttaagcactattaatcaaacactaaatgctttttaaacagctctacctttttttctaattgagaaacagagctgtttgggcaagtttatgaggtgaccttgattgaattaaagaggtcagcgatggaacagacttcaaacccatattcaatgatttttttaaaaatgacttccttccaattaagcagaaattagcataaaatattttgtttctgaaaggttaaaagaattcctctgagaaggcagctgtcttgttactagctttttattgaacatgagagggaagggactatgggtagtttcatctaaagtgctttgttaacatgacactgatgatccagcatcaattacaatattccttaggagcctaagtgttacgtagaagggtcaaaaagtccattttaaattttatttcctatttcaaagtccaagaacccaatgactttcaattactaagaaagaaagaaaagaaagaaagaaaaaagaaagagaaaattaaatcaacatatagtttatcatttgcaaaaattgcaacctagttctacagaaaaaagcttcagtcattacctctttaattcaatcaaggtcacctcataaacttgcccaaacagctctgtttctcaattagaaaaaaaggtagagctgtttaaaaagcatttactcatcttcctcttagccccatccttctgcttgccatagtcccccacattttaatgacctgaaagaacatcaccttcttcctaccaaaaagagtaacatacagagtgtctgatatataatgatggaagcagaattccacagaggggagggggcaccacacacaggtgatactttggggactactgggtgtgtctgaggcacagtcaccctgagagacacactcgacataacatagtgctctgcatcccacatatctacccctgccaacctcaaagagtcgagtggacgtggattatatagaggagagaggcacaggagtgctagagaaagagaaggggctctgaagccagataccagctatgaggcttagggcaagaaactaaacctccaagagacctcagggtccttatccaaaaaatgtagtcagtactgtgaggattaaataggtaatagggttttttttttttcttcaaaatgaaaaaaatatcccccaacagattaaaaattagttcttcctagttttaatttcctatccattcatttaacaaaatcttgcccccctaccatgtacaatgtagtgggctgggcattctttatgttcaagtttatgctctcacacttctttatgttagagtttatctactagtttttggctatgacttcggagggcacagtgggcagagactgtgaggacctgtgatctgacactattccaagaaaagccgaactgatgttatgctacgaggatttttcagaggagagaagcaaccctttcagatccaagtcagtgtctcagtctttcaagactttgttagctattctttccccttaatctggcactgtaaagaagacaaaggatatggtcccacacacattgtgagaatttactgaatatttgttgttttaattttatcactgctttgtattatgacattgtttaagacaattcgtggaggcaaaggattaagggtagagaaatggatggctttaggaggctcggtagataaactacactagaaaagtctagtattgcatgtggagacatttcataaacaactgactggtaaatcactacaagaaaaataaaatctctcatggtacttccaaaatatcttctaaatatatgttgtagattaagttgtgcctgaaaacttgtaatcacaaaaaaatcacaagtatcaaatataaacttgtatttattcagcagctcacctgatcattatttgggggtaccaaaattcatttttctcattaatttaggacattgggggaagggagaagacatattacttccaagatcagaatttccctgagtctgtgaatctcaagaagattgatattactgtagatgaggtccctcagactcttattttaaagctatattggaggcacatctcataaagaaaagcctcgggaatagagaaacagggagaggcacttcaataagtcttgaaattagatggtgagtcaataaactggtgatcctcaggtaggctctcccagaccctgggggtgcaaagaaaacatgggatgagatgggaaatcaaagggctgatattgtagctcagatcatttcagatcaaccatcaagcatgtgcctgaggtttgaggaacgtcttcatttttctctttatctttttggggacttatgaaatggaaaacatgggttgtgacagtgtgtatggttaccaaaggaaacacataacacagcagtgaacatccctatgcacttcacctcttcaaagcattttcttttcttctttttcttgtctaaagccatacagcagactctgctttcaggaaataaatgtcactcaattagcaaatgggtggtaccaatttccagaataatttttaagggtggcatttctgttgggatgggcttaaaaagagtttgctgggtgcgttgcctatattgaagcaaatctccttctaggtagtgggaaaatacagaaaatgacgggaagaccaagcagaagccccagtcggctttgtctggattaacattttaaggtaataagcatctccaggctacctttgcctctaaaaggcattatggcaccatgtacactgcaggcactcaaaatccttcgttgattttatttggttactgactcttatggtatcactgaaggcatttgaaagagattctggagtccttttcccataaaattcattggtgccataacagggtcattaacctgaaaaggagaaagctagtattgagctctaggctttccacttacgatcttgggtaaataacataacttctcatcattgccaatctctctgtgggtaagaactcaacatttctgcctggtttagaacttgaattatttcttggatccattatttaatatttataccaatatgattagctcttagaataagaaattataagattatgtggtctgggaaggtaagcatattatggtgagttaaatgtggaaattccctaatttaaagcaaaagaaggcaattcaataaactatcattatctgatactagttactattccttactattcttgactttccagaatgactgaaaatgtctagggagtattcctcaatcaacatggattttttcatagattctcctaggtaatttataaattaatatttattgtagttttaattatttaaataatacatgcatatattgacatttttgaaatgcacagaaaaaaaatcacttgtaattacaccatctggtgataatcagtctgaatattttgacctatatcctcacagattttcccctaacataaattgtgaatataacacatacacacacaattggaattatccatgctggtttgtaactgcttttatcacttcacaacatattgagaactttctttcattccattatatagtctaaaccatggtttctttcaagactgctcatggatatacattaattaatcaataccctagtgttcaatgtttagatgtttctaaattaattctgagaactgataatttaggtaactgctttgagctgcaatgaccagcatgccccaagtagaaagcaagggcctttgggacacagcagctctagaacttaaagggggctcattaaagaccctgcaatgccctgccggaaatgctacaattaatagactctgtcttgtaacttttgctccagaaatgttcttcctacttctctgctagtgatgggagtctaaaataaaattttctttctctagccacttcctagaaggcttcacacattgtgtcctggaactggggagaagagttgctgagctcttgctccctctttgatatcaagagcattcagtcaagtgaaagagaagggtctctaagccatttagatgtgggagagcttactataataataatttcctataaacttcaatttccagggcttctaagtatcatataatggcaagtagaatttccaagaaagggaaggaagtacttactttttaaattagttatgtggctcttaactacctacggttactagaattctacaagacatcatcctgtcttcattttctgtgttcatgcagtatccctagcatcttcaagtcttcgattaacgaagctcatgtgcaacagtgttaggagtcaaggtataatagctttatgtcacctactgtgttttgatgaacaatacagtataaaagcagaggagaattaggacaatgatgttcatcaacagcacatcactgtgctaagaggctggtaacagtgtatgttttaatgtggcctagtactgattcttttggccagtgtcctactttaacaatgttacagtcacacttcaagatttcagatggagaggtagagaagaaaatcaatagatactatttttccactaccaactggcctacatatatatagcttctctgccatactcacattcaagggacctaaaagatgcctttggaaggtctggcccagttaccatgcttttaataacctcaggaatctactctgaccacctcaaagattttagcttcatctctcaaaggtccacaggaaagagcctatgatccaggaagaatacaaacttatttgttctctattttctattccattaatatataaaaagaaaacttttaacaaaggcttgcttgttacacaaggactcttgtctgaaaccaaaatcatgtagaattttattcctgagccttaaaaaatacacggaaaaatacttatgtagttaactgtgcaaaagaaaaaaattagaagccaaaacattcttctgtaatgttataacacaattttgttttcttctttattcattattcttagttgttaggttttcaaaaatgaccaggtattatttttattcaaaaaacaactttcattttttaaaatgttacatgctgctagagcgcaatgaggtgacctactgaaagtgttttctatgagcatctgctagaatcacaggtgagcatttgacaaaattcatcgatgttgtaaagggtaatccgtttttcaaaatcagagattcctgagtattgcttataaatgaaaacggaaaatcaggaataaattctactgaagaattctctcctgtgtttaggaaagaacaacaacaataaaaagcttacaaagttgcccagattctgtcatctaaactccttcaaaaaatatcctgattttttctagaagttgtgcaaaccgcacttaaattccaacaacactgtgttaattttgctcaaacgcaagctgaaaacatattttaacatcctgtcagaatgagatactaagagtgtcgataaaatgacactaaaataaatgtaaatttggattgctgttacaagtggctgcttggctctgctaagacgttaggttgctatagtactttccatagcaactttgcatcttattacataaatattccctcagtgtccttcaagcctgctacagaaacaggattaaatccactctcctatgtaatgatcctgcatcaaaccttaccggaatgaaatgcccagaacacataataaactgtaatgtagataatggtgttcctggcagtcaataagcatcagggcactttgggctgcacacaggcggcggtgcagtgaccctgtactactccctggtcatgcgtcttaacctttcccaggtcaaggcgtcagtggctctccctttgtgaagattggttgctcatgtcctcattctcctcctctccctgccaactgcccatcagctcaagccctccaccaggctcaagggactcatagcactaagcaagaagccagggcctgacaggagctgggaacatgctgggctgtcatgcaggaaactttgtggagaccccacccaggtctaagctaggatcaaacaggtatggattgtttaagaacttcagctaggcctcagctgaatttcaccgaggtgtggcacagttgagtagttaagagtattagggaaagtccttggtcctgtagacaccaatgtcagcaacacagattaatcttacataaaataccagattatggaaagtttgtgcacatatgagagagatgtcaagaatcatggcattgataggtgctacataaaaataggattataaaggggctaagcttaaagacagtttaggctccaagtgtgaatttacaaaacaaacacagtctggttgggcagaaggagtgcttccattgaaatggaatcttctgctacaggatcaatttaaatagcatctgttttcctgcatttaaaaggtgaagcaatttacaaaaaaaaaaaaaattctacacttttcagaagcatatccattacggaaagggaattgtaactgcacatgaaattagggaacttaaaaatccacccaaaataaatatttatttgaattccttgggcaagattagcaagattaaaagaaaaaaaaaaaaaggaaagaaacaggaaagccttggctcctttgcaaatgaaactctgtttagagtttaggaagaaagcaggctactcagcccaccttgcaagatttcttttatcatctttaagccacattagttctgattcatcacatttccttgtttggcccccttgggttcccagaagagaaaatgcttgtctttaattcagtggtcagtgatggacacaccccactggtctatttctctttcaggagatggtgccctcggctgtcattacatgtgaaaacagcttatccttctatgcttccactcaacacagacacccctgcccttggggtctgctggcgcccggagctcagatcctggcatgtggcctcagactgagccatctcactttcagtgtctgaattctcttgtccctctgccaagttctgagccaatctcgggtgagcctgctttcagttacattcagtgcttcctaaaaggaagtttctaccagtgtgaatgacagagccccttgcagttggccccttcagtcagctgctgcaccctggtctggtatttagtaaccctctccttcttctgtgcctggctggtgatggggtaacagtgagcctcttcttaagcttgtgcctgattataatcttcctgatgggcatttttaaggatctttcagaagtactaccacccagaaaatacttaatcagaaaaaataggttgtcctgctattcaaagaaatcaatgggatggtcagagagccctattattattatttttattacttattttttttttaacataaatcttccagctacatatataactattcagataggctgatactgctagttccaaccaaacctaattatgagttcctaatttgatttagtggctgaaagatttggaaagtccttgtttgaattcttagtgaaattaaaaaaaaaaaattccgggccaggcgtggtggctcatgcctgtaatcccaacactttgggaggccgaggtgagcggctcactaagtcaggagatcgagaccatcctggctaacacggtgaaaccccgtctctactaaaaatacaaaaaattagccaggcgtggtggcgggtgcctgtagtcctagctactcgggaggctgaggcaggagaatggcgtgaacccgggaggcagagctcgcagtgagccaagatcatgccactgcactccagcctgggtgacagagcaagactccgtctcaaaaaaaaaaaaaattcctttgtacctatgttatggtgaattttcatgaaaaattgacagctcagaaaaacactcttcataatttagagtgtctgctcctataaggagctcagagtttaaatgaaatgcagttaaaatccaaaaacatttgtttgtgtattatggaaaggcataatgattgtctactgagcaagggactttttagttttactcttctaacatttgtgttcaaagtacactcatcaaatattgggtgaggtacatacactatgtagtgatgttcattttggtttataataaatttaatttaccagctttaggacatccctaatatttttaactgaaaacacttttttcaaatgagtcttacaccctagagaactgggtaccctgtatctaactaactctgtgtgccctgggtccacagcaccttggacatacaaaatgtagataatcaaaacagtgctgggttaaagctctctgggccatggcctgttcgccatgtgacactgaattttgtacgtataaagttctgaacattttgtttgaacatgcctctttaatacttgccatttcaatttaattagagcaaatgttctcagggttatcatcctcctatcaacttctgggacaaaggcatcgaaaacattaagatcagaagaaggggaatatgaattgaagtccacagacttttattgattacgtacttggggaaaggcccagggccacgtgttggaggatgactaagataacaagcagagttaacatttattgagtacttactagatgctcaacactgtaagtaaagtcagaagtgccttgcatgcattgacttattaactctcacaatactaaaacgtatcgggttttgccatctgaggccttacaatctaggacagccttcctctttcctttctcctttttatttcttgcgaacgctatcccgccccacagagtcaacctggagggagagagggaggaagggagtggaaaagggtaagggagaaggagagagggagagagagggagggaggaagagagagagaaagagaaaaaggaagaacagatctggattttaaagtctggcttcatttcagtaggaggcagactaaacaacaataaatttgaatttttatcaaaaattatcttcacaggcttcagagcaggatgccgatcttctagaatgaatgcttcaataaatctgtcattatttttgaatttattaacaaaattgattttcatttttatcagcatcttagttttgctccagtgaactccttttcccctttaagattcaactgatcaagaagagtgaacaccccacccagaattctattgtagatactgcagaattatagccaaagacatattgcaaattattatatatggtaaaaagaaaagtacaatgaaatattcttcataaccaaaaagcagagatatattgaaacattttgattattttttaaaaagtaaacccaaggtatcatataagtccttacacaataaattgtgcctttcctaaaaaccaaacaagtcaattatttccatctcttccctgccccccaaaataaaacccattacagggtactttttgtcttagtatggagatgacaagcaaagctggccctgggggaccacagacagagcgccctgcagtgggtgcagcctcagcacctcctcccggcacaggcaggtgacaactgaaggatattctcttctggaatttccaagaattcctgggtcagctactacccaggaggtctgaagcaaaatcccactgtttaagcagagaggaaattggcaggggattccttacagcatggagaatttcacttccattacagcactggcaattcccctgttagtgaattagagtgctacattttgagaggactgctcctatgtaggtgactggcagatgcaaatgtgtacctaaaaacaagggatgtgtcacccaagaagataccgctggaaggtgtttccctcgggctatggcctccatcctcctgcttcaagcaacagttagcagggatttgtctgaggtttgaacaaaagaccagatgggaattcttgctgtcaggctgtgtccccaaatatgcagggctgaaagaaaaacaactgcctgcctttgggccagatcttcagggccccgtggaataaaaaaggttagttgccttcctttccctttaatcagtcctgtgctttcttcagaaaccacatgccacattctctggtccatctcgttttgaaaagcacgaaaagactttgaactgctcggggcctggcatttgaactccggttctttcatctcttccctcagaacttggcatacaacatgccctgcactttgctcattaattctgctgaccaagtaacaagactggtgaaagttttttttaaaagttcaggctctacttcacgttctcatcagatgcctggggaataaaccgagagaggtgtcgggggatcacatctccgtcgatgcttctgcagcagaggccgggccccgatcctataagcatgtacgtgccgcaagacctcagtgagcatactattcagagtcatcattattctggtcctatcctaagcagactatgaaattatacacaattcttacttgggaaattgacaagttatttaaaaagaaacatcaccaagacaaaacaaaaagccacaggttcaaatgagaatttctgactgatgcagttcttttctcctacacctaccttgtcaggatattaagaatccaagtttcatgtcaacttgcctctcatccagaagcttcacaaaggatgaaagcgcttttgacaaaaaaaaagtttatttctttatttgaagatcttgttgaacttaagaaattcacacaaatccttgcccccttcttttgctatgtgaaggtttgtagaatagaaatcctgtgaggaaggtggtctcctcaaataaacaaacccaagagtaaagcagtcctgaggaatctgatctgggcttagcaggagacatacatcattgacacataagtgctgggttcatttttcagacaagggatatatggcttcagaaaatagtggcatggtgcctacttgtatgttaagcacctgaaagattaaaatgaatgaatttgagggtgaaagggaaagtttctaaggcagtggttctcaaactttggcatgcatcagaatttcctatagggcttaaatcacagattgctggacttcacttccccacaccctgtagccactagacgtttttgattcagcaggtcttgggtggggcctgctaacttacatttctaataagttcctagatgatgctggtgctactggactgagaaccacacttttgagaaccactgctttaaagaaattagagccctttctctatatgcctgtaggcaggagctttttcttatgaccatcactcgcacccctacattctcttctacagccctggagaaacagagcatcctgaccactttgcagtcttggtgacctgatccttttagaatcttgattttggtttcttaataaattagtaaagatcctcgattcctggtcacctgcaatctttctgttaaaaagtctctaacaggtgtatgttttattcacttatacacatgaggagacagatcaaatctataccatctctgtaattttcttttttgggaatgatggcaattatggttcttcctaggtccttcggacaacacccttccaatcagacaagcagtctcccttggtgtctcatgttttgaatgagcttttcccttgcctgtttttacaataccaatggatttatatataattcaatgagagcgttttaaatcagcagctcccattagacagagcacacaaagcaaggttctctctaagtttctcttctttgtacaacctaaggagtgacacccctagcttggtaccaaatggggccagccttttaattacagattaggtgaaagaacatttatgggaaaagaagtctaattctccagcatcttggctcagaagctagaaagcttcttcagggattaaacaattcccatgtaagaagtacactgactaaaaccaaattttatccatatttttagcatcagctgtggctgccgtactctggaaaaggattttcatggaaacaggcaaatatccctgaaaaaagcttaatggccccagatctacgtacggagaaacaactggagcaatttaaatcactctgttcccaagaaggagtttaaagttctattaataaaaagcagagtcactcaaagatgaaagtttagtataattcaaataaaagtgagttatagggccatttacttattccccatctgagatttggaagatcattatgatacctcatgggtctgtggcagttatcggcattacctgattcatcgactctcattttctttgtagggctgtcacagttctcatcatcagacatttccatttcttcttcgcggcggatgcccatgagctgctcactttgagcattccggagctcctgcaagtagaggatacacaaatgtcagagtcacagacacatatggctttccccaatggtctttgggtatatatgactggcatattaacattcagaatccaaagcttttatctcccaaatatagcctcacctaacctaaaggaggttctgaggggtgtggggtacaggggagactgaggtcaggcttagattaatccctgctcacccatgactagggctctttagcaaataatttaatctctcttgagtctcaatttcctcatttgtacaaagcggataataacatccacctaatagggctgcaaagattacatagaaatacctgttacatggctggcacatgtacagtaaggacttagaaattatggttaagaacatgaacagtggaattttaaaatggactgttctaccactgacccacacggtgtgacattaggaaggattcttcatctctattaacctaaattgctcactggaatattatgattaaaaatagttttgaggatgaaatgagttaatgaatgtacagtacttagcatcatgccagacacttggtttgctcagttgataatgctggacattattatttctcatgcaaacatagtgcccctgcatgtgtgtatgtgcccatgtgtgatcacatacacacacaggcacacacacacaccattcagatatccaaaattcaaaattagtaagatgttagggaacaaaacacaaacagatgccctttctttcgtattgcacacggtcatgttggggttactgtttttgttgcaatggttgctttagcatcacataatttagagccacagatcttaagatcacaccttactttctccatttattaggggagtgactacaatcaagttatttatttgagactttgtctagtcactcacaagtgaggaataataatacaaggctgtttacatgtagtagcatatgtgaaaactcattgtaaagattaaagaattacacaggaaatttcttactactgtgcctaaaatctgaacattgtaatacttatgctaagtatttatattattattttgtatcaagctgtatattacatatttgtgaattcttccttattcattctgttctcttacatgtactatcttcagaaatacttaaaacaggggaagcctccattattctttttccctctgtaaagtctctaaataaaaatcaaatagttaaaataatttcatgttatgatcaataaacatatgagtaataataaaactaaattactacaactgatttattaggggcatgacttgtgcccatttgatggacatgcatatatcactccatgttatgggttttctccattcttttctctccttagctcacagattttaactacagcatgatggagaggaaagtatttattgctaacagcatttgaatggtcaactctgtaccctgggaatcacccttgcagaagacagggaagggagaaagcagagagacaaggtccgaggtggggtgcaggggcaccaatcacaggcagccctgagaggccagagggaaggcagacaaggctcctaatttgattatgccacccagaataaacaggtgccaattccatcttaaataacaccatcaggcattggaggtgggtgtcacatgtgattagtgcggaaatttttaggctgtggacagctaatttttctactgacaaagagcccaattcccaaagaggtggcttaacacttgaaacaaggaaaagtcaggtggaaagaataaatgaggctgaaagggactgttgtttagtccctgcgattaatgacaaactgtcatatggtagttgttcttgtgggaaagggtggtggaaaagaaaaaaaaattgaggaaaaagagctgagggtgtttccacagggtgcctctggttcagcattaaatcactagtacactctaataaatctgtagaggtgttgcagataattaacagatgctgtacatgggaatgtgggaaaaaatcaagccaattatcaagcttatacgcaactgagaaatcatccacaatgttaaattaccaactggtatttaatcaattcagcgacatgcaagagaaaatcacagctaatttagaattctgtggcctaatgtatatcaaaagaggtggggaaagtagcaggaaggcaaaaagacccttcgcaggagcacctttgacagctgcactccatctgtccttctggagcatcatttctgtctcctagtaccaaacaaagcaagcaggctccttagacctgcatggaagccttcacacgtcctgctccccaccacacccacgcagaggaggcagggttaagcgaaggtgagaagttgaggcagacatggcaggaagtgtgattcagatcaatatgtgacatttgctgacactcacattctaatgatggcctttttatgctcaggtttattcggcagcaggccaccagcctttctctcaacattccttttaatcatgtttggtttttatgtgaaaaaataaataattcacagactgatcattcccaaatctgaatcatagtttatggactccaatttgtgttttcataaccctcagtttgtctactgcatcacaaacagaggactcttttttttttaatcttgaaaatcagccttgacctcagtcttaagtcagagtcagggagaacatcaggtaagcacccttcatttttctggcccctgaaaaattaaagagaaatcccacctcttccttactcataatcctgaacagaaaaacagaactgtatcagtcaccaaccaccgtaggcattagtgaacaaactaaaaaatgtccttcttaacaataaattgcactagcattttaagtgtcacattattgtgaagtcattcggtattcaccataataacagtgataataaagaattcatttggtattcatgtggatattacatctagtgctattggtattcaactgtaatttagcattagttaatgggcacttaaaatgctacccaaatgattgatatcatagtactttgtgattcctcaaactctatataaaatacttattttacaagtgtaagccaaaatcattaaataaataaaccttaccttccataagtttgggattttgaaagaggggaatgtcatttagagaactttaatattaacatgctagagatggagaggcatccaaatgaaaaacattctttcattaaaaaaaagaagcaaagacagtatacttacttttaaattacaggttcaaagcgtacactactctgtggagttaaaaataacagctggacgaccagtgactaatgacacattttggtccttctaagtggcaaggaggtcaaattctagactgttctcttgggggtagatactcacttcacacatgcatggttgctgatgggtggacccagttggcctagatattcactccccttacaacattggatctggagagaagtgtaataggacttaatggctagcatagggactaagatgttgcttatgataagaaaatatggacggaaaggcgtacttgtccaaagagcaaactgtcatcatcacgtagaacactaaaaaaaaaaaccctctgtatttaaaagccagttttctattgtaagctccatttttcttcaaaataatttgctagggaaagtgtcttggtttatttctgaaatctttactatgaatgggaaaaagtattttctcccattgcaggggagaaaaacactgtgttccctaagtgttaagtcagctgcttttctggacaaggaacaaatctcagctgcatttggagctgacagtgagatcagacaatggcaggcggactgcccactataacagaaaccatcatggctgcagccatgctattctctgccaatccagctgtgtgatggtggttaaaaagtaataataaaatcaccaacctcagaatgctttcgccaaatgtctatgttcttgcgctgggctttcgagaaatggtcccaagctttttgtctggtagaagcgttgaaaacggccacaatctgctcaactttggtgaacaaggaagtcaaacaagacaagtaatttatgttgtgatcactatagggaagcaaagcaaagacactaggagtctatggatgatgtcacaatagaaacaacatcatcaatatccatccaatttgtgcctttcgtacttacattttagcaaggttggggatgtctcccttcaagtctgtctccacaactttaggttaaaacaaattctaagtatgaccgggagaagggcaagggcatctacttccaagcattctttagctgttgtttcaatatgtgatttggtctatctatatacctagatctatagatatatagacactggtgttggcatccagatatacagacaaagtaatgcaagggttgggtgcagagaagtgaagtcagggagaagtggctgaacgaggaagagccaaacatatcattttctcttttggtctttatctcaaggactcaatcacagtcctctcaagacattatcatgtccaagttccaaattgggacaatgaatagccgtgccatgtctcccctcaatctcagggggccatttttcctccttggctcctttttcctccccctgttgcactgactgcagccagccctccagccctctggcagggaacaggaaccatagcctctacctcaagacagaccaaagctcacccaaccagtggcactggcatgcaggtcttatttcaaccaccatatggcaccctccatagctcctcatgatcacattccattatcactttcacaaggctccccgccctctggctcccagaccacttgaagttctaactctattatcttgacttaatttagtacttctgctgctttcaggcctggtgctactggactggtaaatgttgaggggttatgaacaaaactacatagacaaaggcatgggctcttagtagtgggtattatgggtggagccaactaactgtagacttaatcttgcttaaacagttattgatccagtaagcatgagattaaggaaattaaagcactaaattaatcatatgattaaacctgaacttctaaatttttagttaagaaggctcagttaaaattagcttctcaaggattctaacaccccatcaacataaatctttcataagtgattcccaaggctctattataaaaaaggacatcaaagctcttccaaatcttctggtgtccaaagaatgtcaaagagcaatagagtaatccccacagaagaacaacacttggtgccataatttttaaattagcacacaaaataaatgtatgatggagcagaaggaaaaaagcagattccattcacttacaatatcgtgaatacttttctatgctgatgaacaactacttctcaatctatggctgattttcacagagggcttttatctttttgctattaatatttttactattttccacttcaggagaatcccaaccccaaatctccttatttagcaaaacctgtcatcatgtcacatgatgaatttatttgactcaattttaacaggaggatttgccttcaatttgtctcatactctccttgggcacatgtggcttccctcctcgacctcaactggaagaactaaactccagactaaacacctggggctgctctaagtgctggccatcagctgaccactgatccttagtgctctggttggctgtcctgcagcacagctggcagaggagagaacctgttccagtggatcaccggggctttctgcatgttttgtctgtacacaggctgggatcattgggaatttcagctgccttctgtaggggcaacacagaacagtcagccccaaatctaggctggcaggggtggtgatcaagaggttattaaagagtaatgggcttcgttgcttataataacatagctctttggcatcatttagaagaggaagaactatgatgtcctgacaccagtcctaaggggaaaggacaatatgggttgagactgagtgtttggttggtaatagtgaaaattctgacatcaatcagagaaggctgttaataaaaatgaaacactaaagaaaagtatatctgttcataaaaacgtgtaaggggccagagagaatgaaggtaaggaagactagtaatgcacctggaggagtacagaaaagaaagaactaagaagaaggacccaatggcccaatagtgcacaggtttaggggtaaaaggagatcccctaatatctactcaagccatgtgctattagatatttcctgtttgtggctaagtgcctcggttacttagaacatgttattaccatatcccaaggcataagttcagttcattcattcattcaacaaacatctggattcctgttagctaccaggaacttgattaattgctagaaatatatgatcaaggcccagtcttgtctttgatgcaatcatagtctcggaagagaaagaaagacaagcagataattatcctgtgcaagagaggtgcagatgacagctttgaagacacagagaagagaagagagtagctaagtagataggtggcattagaaaacattccacaaatagggcaacatttctgccaagtcttaaatagtgaagcaatgcctgcttggcagagaaggcaggagtggcctgttcaaaggctggtatagagttgtgggaggatgagtgaaagtagctgtggggctggggctggggctagtgttaggtatgaatcaagagagaccatgtatgctaactctgattgggaactttatattgtaggattggcttgggagaaattacaaaggaatgaattaaggcagaggctctggcatggagtgtggcacaggcagtcatttgacagggagacttgataggaggaggcagctgacttgctacatgggaggaggaagaggggtgcgaggtaccacgatgactggagctggtaagtacatcccaaactatgagaacaagcatcggtggagggctgagaaagaagataaggaatttacttttggacgtattgagtttgagatgcctgaagaccatccaaatggagctgaaatatggattaggggttcagaaagaagtcagaattcaaagagatatggccaacattttctgggccattctccatttcttgtattctttttcaatagggtaattaattagatgtaaaactaagtgggatttaattttatacttatgaacttatacactttttttccctataccaatcaaaaagcaaaacaaaaacaaaacaaaataaaatcccacaaaaccccaataactgtgtaactcaggtttggaaaccactctcacagtattcacacggcccagttttacctctctcattgctgcacacactgtccctgaaccagccatttgtcttgcaaatgaaagttcctgggcacacacgaaaaaggactctggaggagtgctttcatcagcattaattcatcatcattagggaaaaagcacctctaagagtatgccctaatgaatgtcattcaaagacagcatacttttaagctcataaatcaggatgactactggtattgatgtaaatacactattcattgcttatagcaggaaacaccagagaggaagtccatgaattagatgaccactgactacctctctggtataattcatactacttactctatctatatacaataaaacctgttaagaagttactatcagaacaggctcttcaaaactttgcttctcagagaaagatataaccagcaaacaagatggcattggcatttgttcaaagcaagtagcttatagaagttgtgctgcaggcagaacaaattgagacctactccctacccaatgccttcaccacctcagtggtccacagagtggtggccagaggccccacacaatcctgtatcagataaaaagcatagattctgtttgattgccacttacttattcaagaaagtatactcaaaagttttgcaggtaaagggaattttttttctttgagggataacattttcccaaatcttctattagcaactgaaagagctctccatcagaaaatttaaatttacccctcacactttgcaaatctttcccccccaattctgtgttttaattgtttgcctaaattaggttatttgaggatcataagaaaattaaaaatgataaattcttcagaagtatgcctgaatgccagttttagatatcacagtagagcccctagtatacccagcagctgtaaatgaccttaagggcaggataaacagagccttgatgaagttgctaatcactccacagagctgcaaaccctcactagtggttattcattagcttacacatatgtatgtgtggagatacatacacgcacctagcatacacacattacacacatatatgtatatattcttccaattttaaacaaacccataagactaatttaacaactttttttgcacttttccccaccccaaaatgtttggacatttgctgagtttagagcacacttcttactgatagagaactttacagactatcatgagaagcgctggtcttcagccttctctgggagggaaagctcagaacagaatatccatttatccaggaacagaccacactgaagcaagctccctgggaaaaagcagccactgggtgcaaaagctcagatttctgggctgcacaagactcctgaatttcaagctctgggcaggaatgcatgggagatgaaagagaaaggttagagtcctctagagaacacgaacacagcccttttcccttcatgtcttgccgactgccttctttctcacaggccctgcacctcttgtattccttgttccagctaaatagcggtgaaagagccttaatccagttagtgtcccaaatatctggagaaactgatttagtccttaaaggcagtaggcttgcctaaataaagcacctcaaacaaatcttccaagcttagtttttgttttttaatgctatctgggctcatgttagagcctcaactctgcagggtacacaggacatttttctttttttaagggataacattttcccaaatcctctatgaatagcccatgagagattttcaaagggatatgacacaaatgaaataggtgacctctcccaccccagcttgtttttgttgttttaaaatactaatagctaggggagaagggacagaagaaaagtgtaaggctttagatgtagtgctggaattggtgagccttggctttagactgaagaattataatggagggaatgcagtaagcgattccagctctcaggatacccagaggagcaagacaaggtccaagggagaagcggtatgtgtcggacagcacataagaggaagctgctgctataaaagagattcccagacagactcctgcacattcactcgggttctgggtcctgagcatgaaggagctggcagtcagcctggcagaaagcccaggaaacagagaatgaatacggtcaaacccatactttaaggagggatggaccggaatttcaaatagaggaagaaaagggcattctggggttttgtcttgagatatgttaaaaaaagcctcacatgacattgtgagtccattacagcccacttaaaactgaggccaagacaccaacagcagacatcatattactgaacttcctggctagatgaggccagatatttgttgcttttagggcagcatccccaacgtttttggcaccaggaaatggttctgtggaagacagtttttccatggacagggggttggggatggtttggggatgaaactgttccatctcagatcatcattagttagattctcatagggagcatgcaacctagatcccttgcatgcacagttcacaatagggttcacgctcctgtaagaatctaatgccgctgctgatctaacaggaggcagagctcaggtggcaatgctcactcacctggtgctcacttcctgctgtgcggcccagttcctaacaggccatggacagtactggcccaggggctggggacctctgttttagggaatggaatttgaatagaataaagagaagcctactgatcacagtatataaaaaaacaggatgttttaagcaaatttcaagcaagcaagaaatgatcaaattgttcaaataaaacagaaagatattaggtatatagtgacttttaaagatttgcatcactccaagtatactccagggaattgtagagccctttattaatgcatatatttaaaaattttggaaagtaaagcaatacatgagattataaatctaatagttcctcaaaatatatagcatttattaagctttttaaatccaataaatctcctgcctagattacccctactgactaaatgaaagtaatgtatatacagaagaaaaaagggacgatataaaaaaaaaagtctaccttcccatcttgacaactctaccaagttctctttttaaaggtaaccagtaaccactattaacagatcctagcacatccatccagaaaataaggttatgcatatagtacaaacagtgtgtatttttctatgagaaaccttttttacttacacaaaggtgctaatattatatacgctattctgtaccttggttttttcacttaatatatcttggaaatctattcatatgtatgttatcaataaggctgctataaacatcttccaacatatcttctgaaatccttacataaatatctttataaaaaattcttagcagtagaaaggctagataaaagagcacctgaatttttaattttgaaaggtactggcaagttgcactctatgtccctgaagtgtttttcagtttgtttctcttaccctttgccaacagtgcataatcaaatttagcttttgccattcctgatagatgacagaaggcatgaattacatggtaaccaattgtctgcaccagtgatatgtatgtttgcagtttccattacaaataacagaaacaagtccagactcattgagcctgccctgtattcagttgttggctcgatgctaagtcatcacatagcagcaggaggagagacctggtttctggggatcttttcttctttgtgaccctcgaaacggcaaccctgatctcctctgagtctctactaactcccttagtggttatgaaaatcatataatggtaataggagatttctttctttttgagacggagtctcactgtcacccagcctgaagtgcagcggcatgatctcggctcactgcaacctcagcctctcgggttcaagtgattcttcagcctcagccttccgagtagctggtattacaggtgcgcaccaccacacccggctaatttttgtatttttagtagagacggggtttcaccccgttggccaggctggtctcgaactcctgacctcaagtgattcacccgcctcggcctcgcaaagtgctgggattacaggcatgagccaccgtgcccagccctgtgataggcaatttctaattacttagcccttactgggctaggcactatgcttgatgatttaaaacagtagttatcaaagtgtggcccctggaccagcatcatcaacatcacttgagaactcactagaaaggcaaacactcagactccagacctaccaaaggtgaaactctagggatggggcccaacagactctgctttaacaagctctctgcatgattccaaggcatgctaaagtttgagaacctctgattatcttacctaagttttgcaacgactgtctgaggtaggtgctagtatgaatgcccatttcattgatgaagaaactgaggttcactgagacgaatatttacttgtccaaggtcatatatttagcagtggtgaagttggcaatggaaattacatctgtccaacttcaaatcatgtatttatacccattatatgatgggccaaagtcttatgagctctgtggtgtgtaatgtgctagactttgtactacacactggggataaaaagggccaaatatgcagctggtccttgagctgctcagagtccctgggggagacaacatatatatgattgaatcgcaagatgagaattgcttaagagagctgcagagggtgccaagggaggccaagaaaggcttaaaggaccccttggctgaaacttgcagctaagttgaattttcaatgcaaacaagccaaacattggaggttatgatggagcaggaagctgcatttacctctctacaaaagtgtattgaggaacatgagccacagtgcagaagaatcaaagtgtctggaaaaaaagtccctactttttttgtgtctaccaggctggaaccaatttctctcagtgtgtgccctcagccttctcattttgtctaaaatccagtctgtcctactttttttgaaataaaagtcattgaataagcctcagcaggggaaacttacagaagtggggccaagggagtgtttttatgaatacaacactgttttgggggttgcatgtagacgggaagagagagttgggaaatctgtgttggtcaagtcttagctccatcgctaactagctgtgtgacctgaagaaagtgtccatctgtttgaatcccaaggcaaagggggctaggctagaccatcctgaatctcctttctggctctgggagcctttagaacagggcttagcaaactttataaggaaaggaacagatagcaattatttttggctttgcaggtcatacatctaccttgctatagaaggtgtctacacacataagtggtttctctccttaaatagaaatcctctcactttgtctgtggctactcttccatgattctccccaggtacaattttctttggttggaaaacaaacactaagttgtacttctctttcagttacgcagagtcaagaacacatcatctctgctttaaagtaactttactgacaccttacttttcctcaatttgaaagtgtcttggctttaaaaaatctttgtaaaaattttttttatgcatggattttgtccagtgtagctcagagactgtttcccagagtaccccaatgctatcaacacacattcccctcgcctgatgtggggcagtggctagagtccagtcctagacctgggctcatatcaaagtgacagagttttcatctttagctcccagaagttatacctttcctgatttgctgaatttcacttaatatgcactccaattctttattgttccagagtgtaagacttgatttctatcttacattttggtattattaaagatttttttaaaaaaacataatgatttgactcagtgtatatattttccacgagactgaaaggaaggataccaaaaaaaaaaaaaaagaaaagaaaaaaaagactcatttcagttctggcaggcatagtgtcctccaccatcacctttggcatcctgtgaaacagaacattctgtgctcatccttgatgctgaagtttttatacatattattttctctggatatttattccctgagaccaaagaggtatttttttaaatggaaataatgtttccagcacttaatgcattggcaaatacagccatcagtacaattttgaggagaaatagaaaacctgtcacattgctaaagcagttatggggaattttttcccatggatgaactacagcaatgactgctacagacatgggcaaacattttaacacttcataaaattcctttttgacagcaggggacatagaagccaaatttcccttggtggaaataaaaaatgtttggctgagatgttcctaagaagtaaatgatttcagaaagagcttttcaggcagaagaaatgtggacgaggacaccaatctgcctaaaagggggatcacagtacacagagatcagaaacccctcacatttcactctagcacttagcacacaacttgacacttgataaatatttgtggaatgaatttaatcattcagacacttgaggcttttacaattttacccaagaagatagatgagggcgtgacagtggagaactgtcagtgccctgcgcagctgtctttgacaataattctgaccaatcttcagcacctgcagaatgcaatgcacataacctcagggttgaaatgtggcttaaaattcacagtgtagcccaggaggagtaaccttcacagcaaggtataggcagaacatttgcacagagtaatatctgattgcctgttctatgatcactttaggagctttgaacctcatggttgggtcctggaagatacctgtatttagatatccagagacgataaaggatccacatggttgacataagaactgtggaatcttaagggtggaaaggaactttaagggattactggttaaacccttttattacagagatgagaaaaaggagactgaagttgcttaaaagactttcccaaagtcacaaggctaattagtggtcaaacttggattagaaccagatctctctgccttgtcaaaagtctttccaccatttgcagcttttaagacctaagatgaggctgatgccattacctatcacaaatgtataaagttgcatgacagttctaacctttccaatctccaggttgaaatgatattgataacggtactctaatactcctactgtaaaattctcaactaaagtatatgccgtatgctccactttaaagagaatggcatattagagctaagatcattgagatcacggtttactaaaaaacacttaggctgtgttctgcaatattaggttctagcccaattttcagcaccacgttcctttccacctgtgattggtcaacaaccaatattttttttcttaggtcttctatgtgcttacaagaattatgccaggtccagaagtggcacagtgaggtagaaaagagaacagtaagtggctcatgtctctatttagcctaaaatcttgctagagggaaaatcaagcaaacaaaccaataaacttgatgcacataaaataattagaaaataagtaagtcctcaagtagatagtattaacaagcgctgcagaaggtaggtgaaagggagatgattatgggttataatggataaacaaggtttcatggaggaaatgtgatagaagtggacttcaattttggcacttggaggaggggaaatagttcaggcaaaggaaacagcacaagcaaatgtgtggaggtaggaaagagggtagtgccagaagcaaatacttcattttttagccagatagcagcatttatactcagtgtgatgacagcacacctcttcaactctacctataagctgtacctttacatttataatattcttaattttcattttacacacacacacatacacacacacacacttagaaagcaaactgtacaaggagccaagagtcttggttctaaactgcccataaactactaaatgaccaaagcctctcacgtctgctctctgagactcagtttcctcctctgtaaaatgacagggtttggcccaaccctttaagatccctcttagctctaacattctataatttctgctttttatccatgctcattatatgtatggcacatattcttaaattaatgttaatcaacccttctgcactgctgctggctttcccatttgccttttctccagtttgttcccttctctcttaccaggaagcatgttgggaaagtagcaaaatggggatatcatggagtgtttaaatttttattagatatgtgtgtgttgtaattgttaaaaggcatgcaaaacttatcatcttggcatgcatattaataactgaatgtggtagtccatgcttcctgaactttataaacagctcctgtacgagctttgaaatgacaagctttgttcataactgagaaactgaaagtgggcaggcctatggggagtttctgtgaagtatgcatttttaaaaagcaaagataaaaactccaacgtctccgagttggaaaacctggggaagtttctggcaaatggacgggttaagaaatgacataaagatgagactaggatgctatcgggataaggtgacatgacaaagatgatttacctgttccgaatttttttttctctttcttctatatctaggaaatgaggtctatccagctggcccagaagggaggagaaagccccaggtgccacagcaggatagacgatgtcctcatctaacatttttcataactggacatccatggtcagaagagaaaaatcgccctacacagaagtgaatggatgccatactccccaaaattcaggttgggtttttttttttttttttttttttttttgagatggagtctcgctctgtcacccaggctggagtgcagtggcgccatctcggctcactgcaagctctgtctcccaggttcacgccattctcctgcctcagcctcccgagtatctgggactacaggcgcccgccactgcccccggctaattttttgtatttttagtagagacggggtttcaccgtgttagccaggatggtctcgatctcctgacctcgtgatccgcccgccttggcctcccaaagtgctgggattacaggcgtgagccaccgtgcccggcctcgggttgggtttaattacagccccctgacactttaagctaagactttgctaaaaacaatgactgtttgatatttaatagctggtcctggggtgaagaccagagatataaaaaaggttagaactttcataaatacgggcagaactaaacaccaacaaagctagagggtaactgatggactttgatggagacctttgaataaatcacaactttttctttatgttattatgaatgacttgtgacgtttttcaaacaacttttgttaagcactgaacttcaggaacggtggctggagagcaatctaggccaaacatttgagcctatggatcctttccaaatgaaagcaagaacaagtacacaagcacagaaaggagataggtgcatctaatccagctcatggatcacatctgaagtttcccttgtcctattcaaccaattggttatttccagccaaatccataaggggacccacatgcttttaccatgctttgaattctgcaatgtacctgatcttccctagaagctgcggagtgagccctccgtgtttggcttgtttgcggcctgctccactagttagccagtttgccaatacacctgcttccaaaccacctcacaacaatttcccaacatgcttggctgtttagtggacaggctaccatggaatgccatgaaggacggcattgacactggggagatctttcggcactgacactaaggagatcctttatgtggagagggagcagttggggctgctatggaataaccaggagatttccagccacctgggagaaggaaagctgaggtgcaattcctgaatactcatgcttaacaattctaatctcattctaagggaagaagccaaaatgtgattcctgtggtatttgccaggaatattaatgcagacaaatggggtgtgactggttctgcttttggaaaatgcagcaagtgtgtcagtcactgaggactttagcagttattgttttacaagcatccccaaagtcctgacatcaaacacatcttaccacactgaacagagctgtggaaagcaagaagtacagttgagacacaaacatagctccactagagagagggaaattcgggacaggaaaggagaggcatttggattaaaggatgaggagatgtgtatgtacctaccatgttagtcaggttactgctaatagtttcacagactgggttcctttttgcagccctttttgtaaaagcacatagaagagaatggaaagttctgaggttgctcaatgagatatgcaatcttctggttctgcctcacaggcttaattctagcccaggctcacatttaaggtatcccccatcttcgagtcatcctgaaagatcttggctgtcaaagactcacaggaaggctcctcagagtctccattgctgggatgtgtacaccgtggccagcactgtaggattttcacaatctcggttgatatctgccaactgctgaaatacttctcagaatcaaattacagggctaagggggactcccaaatagtaacaggcagatggtaaatacagaggttgttggatggttacaattggggatactacaacgtaaatttctgatgattctttcaccccaactctcctaatatttcctagcctctgaccaagaatttggtaaagtgtggcaatttccaataaaaagtacagctattgagctttttctctgatttgcttcattatgcatgcaagttgaaaccttgtttcctgcagatgatgctaatatcaatgccaaactactcaacgaggtcaccagaaatttctgaactcactgtttcagggttccctcctgcctgtcttctgatctactcattcattcactcactcatccaccaaatatttcttgcatatttctatgttataaggcttgatatatattgatgacttgatatatattgatgtctcttcctttgtgatgcctgctataataactaaaagcagacatatcatgaaatcactactcatttggataagtgttacaaaggaccttcataaagattcagtgggctgggcacagtggcttacacctgtaatcccagcactttgggaggccgaggcgggcagatcacgaggtcaggagatcgagaccatcctggctaacatggtgaaaccctgtctctactaaaaatacaaaaaatcagatgggcgtggtggcgggcgcctgtagtcccagctactcgggaggctgaggcaggagaatcatttgaacccggaggcagaggttgcagtgagccgagattgcaccactgtactccagcctgggtgacagagtgagactccatctcaaaaaaaaaaaagagagagatgcagtgatggcaaatctactagaagagggtggaccagaaaaacctctctgaagaggtggctcttgatccaagacctataggataagaagaagtcaagcacacagagtatgggaaagggcaccccaggcagaaggaacagaacgtataaagccgagtggtggaaggtggttttgatgggctcagggggaaaggggccagtggaaatgatgcatggtgagtctgaggataactgaagctaaagaagtgagcacagagagctctgtcagctagggacagtgaatattctctaaatgcaatggggagatactcaaacggtttactggggaagacatgacctgatttgtatcagatggaatgtgaaaataaatcaaactagagtagaagtagaaagggaagcactctgtatggcaaaaactgcaaaattcttcctagtagccattctccactcctgccttattatgagaactccaattttactctggagagcagcaggcccagtcaaaaattatatttctcgcattctttgtagttaggcatggccaggtataataattctgcctaatgaaacctacatggaagttggctggggatggatttttgggcaagtttgctttcttgctataatgacgcaactccttcctgtgtctttccttctcttttcttatgtgatttcagctggaaaaagaagatgtgatggcaggcgaagcagcagcaaccatcgtagacaactatccaggtaaagcgaatagcaccagagagacctcagacctggcagccttgaaccactggaccagtaccaacaaaccccacatctggattttactgtgtccagagagaaacatcttctacttgtttcagataccgtttggcagaattttctgttactcacatgtggatgccgtgtctaactgacacatcaagtaaccaaagcctgacttgggtggtggcggttacaatgaagaagggtgggccgaatcggggtatatttttgaaggaagaaacaatgggacttcttgatgacctagaagtcagttgtggtggtgggagatggcagatatataaaaagtacaagactttggcttgagaatttatgagaatgggaaggaaaaaccagaagaggagcaggtttgaagattaaaagcaaggattccacttttgatatttcaaagttgaggtgcctaagaggcagtctccactcctgtggtttccaggagacaggatcttgctggtcctgccccaccccttcattcactccttctcagggagtgatgagccagcctgcccagggggagtgcctgttctgctcacccactcccttgtttaggcatccaaagtgtagcctccaggtaatgtggctggggccttcagtgctgcctgaggctggatgctcaacacaacgtccaacattcagaagccaattattgctgtaaatctccacgtcattttccaatttggtggtaataccaaaaagtatttgtagtcccacatactacacttttctgtccctctctcagttgcttcaaatatgggccaacttacacctatataatgacaggtagacattttgcgttctttcagccacatcacaggggcattttaataggtgcctctttcaatagttactgccaaagaaaacgaagttctcacctattcatggctgccctcttatctttattgttagagccaagggttgagtcttccttgctcattaggactataaactgcatggaaattagaacttatttaaaattgatgccagtgagcaaaagataaaaacatacagtaatcatttcactgttcaggcatatgacttcttaccataactctgaagaaagtgtattattagaattgttttactatgctctctctcatttttctctaccagttcactcttaccttccctccatccactgatccattctcttcttccctcctttaaaaactgctgtaaatattgctttttaaaaattctatccctaataaccttagagtttctagacatacactcttaagtaaagggccattcctcaaggctggtgaatctaggtaatgtggtctggtatcagtctgtgtgaagacagaagtcttatttttcctattccttttctttaaagacagattggtcttatactggatatttgatcacttatcggaatttacatttgggaatttgttatatcatatgctacgctgctgtaaaacctgtctttgataaagtcatgtaagatacttttacatttaagatctcagttttgccctctcttccatcctatcctgacagatacattattccttgtgtttgcactgatgaaagaggtgataggcattttggcacactatatcacagaaaatagtacttatcttcagaatggaaatatacatcccatatgtcactaccacatagggccctgcacctggtatggaatggagcatggcattgttacagtgtcattcaatggcttttaccaagcaagagaacatcggcagctgtgatgcatgatgccactgtgacattaactacagacacagatagagtgcccataaaaaaaatatacgccctttttttgaatagagccctgggtaattaccctgactattgttctaagagaaagccccacttacaccccttcatcatttagactctggacataaaaaaaaaatcactggcattgagtagttaaggcaatttgctttccaaatgaagaaaggacaaaaaaatctctactcttgagttgcccattttgacagccacagctcccccagataaaagatcctgaggagtttttctgatagtacccttttcctacacagagcccaaggaaaatgtgttcaagtttgctttctactgtcagcactaggaggacataggggtctgtgcggacagcctgcaggtgaacggtggcggccctgcagctatgatatgaaccatggtgggtccagcaggcacagatgcatctagctgccctgccctggtggccaggcttgctgttctgaggaaaagctacagaaacgttgctcaccttgagaagtaaactctcagggcagggtccgtgttcctccaagttgccacagaacatgaaataggttatgaagtttgccattcaatatggagtaaaaatgggaaattattgaactacttacccccaaatgaaaaagtaaaattaataaaaaagaaaaggcaaaatcacaacaaaagagatggcccccaaaattttacttacattgagtgagaatcccagttaaggcatttttaaaattctccttggcttcctccatctcttgctcatgggtggctttttcattcattagccggcggacgtggctgttggccgactgcaccatggaatagaactggtttgcagagcgccgattcacttcccctcgttcaatccaggaaagcagcactgtgatagcctctgaaaacttgctatcatctggaaatggaaaaccaccaagtacaaatcatgccaagatgagaaaatacactttattcttgttcctctcaaaagacagagcatagtccaacctagtggatatattttcagaactcagcaagttagctttcctgagactgactgccatatcatcacttaacttctcttttcccatctaacttcagggcaccacagaaccactcaggaggttcacactctcatctaccaactccatgagctcagctgtaggagatttgttctgggcattcttaggaataaggtacagcctcattcttccaccaaaccttgatttctctttcttaagatggacttgaaaaactgttactaacctacttggcctccacttcatttctttgttcctttatcaaaaatattatacagtgttaccagttttctcatttatagaatcagctgagttagtattaaaatgtggaagaaagattggatttttttaaaagtgtttgtaatgtatggtattgtccctaaggcaggtagtaggaataagtcaattcttgttctactgtagttcaaaactaattccattttagggctaataccatatatttaattaggctgaaaaatagaatatttcctaattttccacaaaagagaacatgtttcctgaagtgttccgtgtttgctttagatggctatggagagcccatctgaacccagtttgagatgtatgtgcatggtgtggcggggggataggaagtgggaaatgaagttccgcctgaaaataagtgataaagtctatttcaaagaaaacagacttgcctatttggggatggttactggaacaaacccgtgttgtatggcttggaggtggagaaaaagaaagtttgtgggtgattaagttaattagaactggaagttgtatgtcagttgttagaacattaaccaatctgactactgctgaaggctcattgcctactttccaggcaaacctgaggggagaagcttttcattgtgttctgcaatccctagaaaatgtgctttagggaaaaataccctacatttttacaagtaaactaggtagactctgaattctaaaaatcaggagcaaaattagattgaaagattcagattctcacccattcatttaaaaaatactgagtgcctactgtgtgccaggtactgtcccctccactggaggggcatcggagacatccttatgttgtttgcatataaacatacatacactccacatgaatagacagggggagatgcatgcttgagaaaaagatttcgtttcactcaccagattttaaaatcaatcattgagttcttattagtattttacacatcatacgaaaccttcccaccgttgagtgctttgtaaatttatagggtgctttacaaacatctttagtatcttttctcccaaagacctcctcccagaccaggagtacagcttccttagcatggctgctgcttgcccaggaggtgtgtgtcctgaatgaaggtggggctgaacctaattcaaggtcctacggctgaactctggaaacctctgccttccccaggaaagaaagcagcttttagggatgtacccatgctcaggcaccattctaagtcctctcctgctgcacagcagccttctagatttggggatcaaaggttttttttctgagcaaacctgcccccctgccctcacactttaaccagaggagataactggcctgggaatgcccacaaaacaccctgtgaatgacagactcaagtttccttgaaaatctcaacccataggcacagaacacacttactgagtatcgtagccacttataccattttgttaactctggaatttcagtctaagttcaaccctcagtgaactccagctgcaatggtttcttatctcatttcatggaccgaagcagcttgtgtaagataaaatctatcacacaacttaacattacgttcagcccatggagaggcccataatttagcatgatgtttgtgagaggcccactgcaaccgttactggcagaataaattgtgcctccctccacactctctacctctcttcccaccaatatatgttaggagaatggacctcagaacagacagcagaaataaacctaatgcttagaagaaatctttttttttttcctctgaaaagataacaacagaaaaagagaacactgacttcatgtactatttttcccctttgctgtgagtttcatgtctacataacacagagaaagaaaaatccttaacatttttgttatgagctttgcagggacagagtgtaatgctgttcacctctttctgtcatatacaggtagtttttccttctcttgcttgtggtcgcttagttcataaatagactaactttactatcaggaaaaaaaacacttcaattttaaaaatgcatgtttgctcaaatgctctgaaagccacattttattgcccttcacacctagacctagagcacaataagttcaccagcagattatagtttcagaaagaggaaacaatattcttaggattaagccactgaaaatacacaatttcaaaagtaagtagccaagagattttctaacatgttaacaagtactaggaagcagaattccattagcctaaaagaggaatatagtttcaaagactcccaatttcatcttcatttctgaactttctgaaactgacaggccgatatatgattgatgtactgacattcaaattaaattaaaaaaacattagttaaggcatgcttgataactccagtcaatatttgttgccatgtaagaagtgactttaatttatattaattaagactaagtcagtaactccctctggatggctacaggaggatattgggagcggtcattttcaatactcaactgtaaattcaattttgtattcagtggaaagatcactgagaaagcagaaaacaatataaactaatttaaacaggatttagattgcagcattattaaagctattcatgtggaaagaaattaacactgcttgtaaaaatcacatcaaacatgcacttataaaaattccaaatactttctgtgaacatgctcaggcataactctgaactggatgcagtttagaagctagaatgtgcagatgtgctttttccactataagaattgagaacgattggtatatgatggagtgaatataaatcatttgctcattagaaattacccaccgttttctaatcaggtcctcacaatgttaatgcacctgagttaatggacaggtccattcacgggtcttgcctttttcccttccatccgtccgtccccgcttcctttgccagagccctctttgttaaacagcacggcgtgcctccctgcatctgctcatgctgtgcacttatccttgggtctctcccactcctggtccccctggtcagctgttattcttccctcaagattcagcgtaagtgccctttaataaagaaatctcttctgcaactctaggatgaattaggtgtctctttgctatgtttccacaattccccgcatatcctgctattaaagcattagtcgcactgtatggtaattgttggtttacagatctgtctccagttttgaggggctaatatgagaataaaatttccaaagacatatttctagacatatttctgtcttctggttactctgagtttttccctttgtattttatattttattgcattctacagtagttcctccttatccacagtttcaccttctgaggtttcagttaccctaggtctcagttaactgtggtcaactgcagaccgaaaatagtaaatgcaaaattgcagatacaagcaattcatacattttaaattgcacactgttctgaatagcataatgaaatgtcacgctgtctcactctgacctgaccgggatatgaatcatccctttgtccagggtatccacgttgtctacactacctccctgtgaatcacttggtagccacctgggttatcagatccactgtaatggtacagcagtgtttgtgttcaagaaacccttatttggcttaataatagccccaaaatgcaagagtagtgatgctggcaatttggaaatgccaaagaaaagccaccaagtgcttcctttacgtgaaaaggtaaaagttcttcacaataaagaaagaaattgtatgctgaggttgctaaaatctaggataagaacaatttatctatgaaattgtgaagaagtaaaaagaagcttgtgcatagtatatatagtgttcagtactatccatggtttcaggcatccactggggatcttggaatgtatcccccaaaggtaaggggagactactgtattcctaatagatttgtagcaattaatactggaaagatacaaatgtaatggttaaaagttaggaaacatcagagttgataataaacatttaaatttcatgtcaaagagtattttcacacatgccattatctacgagagatagatgttctcatgacaattaagctgaatgatcccgttatacttcaggcttcagaagtcattatcactggcaatgaaagttaagagtgatgtcagataatcccacagaagcaaggccctctgcagtgaggcactaaacagtttatcaaataactcaaaaatgtttttgaaagcatttttaattctgggaacgtaattgctctttagctttgtgaggagtaaataatattataatgatactatcagatgtcaccactggaatccacgcccatctcatttcatttctggttatttcagactttgttaacccccttccttctccctctcttccacatttattgagtacttggcacatagtaggcattacaaaactgcatatgggagaactctttgctatattctaagaccaggtgcaggagcagcctttgtgagcttgttaaaaacacagactcagcctttctcacacctccagaattggaatctgcattttactccaggtgatttgtacgcacatggaggtttgagaaacactgaagaaaggactcagtgaaggccaggtaaactggttaggagctgaccaaagtaagagataatgaaatcctgaagtggaaagtagcagctgagatactagagactttcaaaaggaatagatgtgattcttaagagctttgtgagtctctatccctgtccccacgaccaattaaatccctgtccccacagctgtcacttctatccaggaaataaaaagggttcaagacttggaaatgggcatagagattactatagaccctttctatggaatgctgggcatgaattacctaattctacagggggtgggaaactttaattctttggctaatctctgactaggctattttacaactttgtaggagtagaacataaattgtggcaaactgataacaatacaaataattcgtctctgtaacaatgcaaattaatttttgttcagtagaaaatgtaaatctttataaagcgaattctccttcgaaacagttttaacattttcttggtctccttattaattagtgagttaaataaaatcattggcacatgttcattttatatttgtaagacagtcatgatttcaccgccacagtattctttaacaaaagacagggcccatgctacagtcatatctgaaagtccagggcatggcacaaagcgatgggtacctggtgaattttaattaaactgatacatagataatgatggggaaaataaaccaaattggtaagtgttttttgtttttgtttttgagatggagttttgctcttgttgcccaggctggagtgcaatggcatgatctcggctcactgcaacctccacctcctgggttcaagtgattctcctgcctcagcctcctgagtagctgggattacgggcatgcgccaccaggcccggctaattttgtatttttagtagagatggggtttctccatgttggtcaggctggtctcgaactcctgacctcaggtgatccacccatctcggcctcccaaagggctaggattacaggcgtgagccactacgcccggctggtgtttttttcctcccgctttgtgtgcacagggagaagcagccctgaatttcagaacaatagataggataagagccaagccgggagcactgaatacgaaacttaggtgggctatagtatccttatttacagctgggtctataaaggaacaatgaggagacagggattttatgtttgaacggaacgagggaaaacaaggaaggcattctaaaatgcttttctttccaaagaaatggagggacacacacatgtgtacacacatacacacacaaggaaaggtatgtctgtagttatcactgatttctggctccaaagatagctggaaattgctcacagtgtacagtcacagagtcatctaagcagatttggaatttcagtatggtcaaagcattgctgctatcacaatccccaaatttctgtacatgtccctaaagaagtctccttttcctggctgctcaattaaccccgcatcaactaaccagatcacagacagcataaaaggctaaacaaagagttaatgttcccttctacccccaaaacacacatgcaatctccttaactatttagtagctgtaaaaatgagaaaattaagggggcaatatgaaaatgcactgattattcctgctttagggtcgagcaaaatatttctttttattttatttatttattttatttatttatttatttattttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttgcttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccaagcaaaatatttctaaataaaacggcctatcttgcctctatgaaggtcaataacacataaggaaataatttgcaaacaggctcctatgtttcatatttcccttactctatgaaggaagcctggcttttagctaatgggacatccacttggctcataacattattgatttttactttcatggaaccataaatactgacaaccatctcagcaaaatgctggtaccacatctgccccttcctccctctggcaggctgacatgaggctattctatatgcaaataagagtccagttctctggaaattatgaatgttgatcccaggaggatggtattcttgttgacacatcaggaaatcccaaaggccctgcctgcaaggctttgtcaggacgtcacctaattcagagagaaactcttcatttcatcacaaaatgaaagattatgtgaagctttctaagggggtacaaagtacgtaaaaacttttaaatgctcttgccaagagaaatcccggtgaattagaatataatccttcctcactgtctaatcaatctcttcctcccacagtccaaacacagggttcctccaggggtggatggtctgtgttagacacactgaaattcattatctcatctgcctggttgccactgtttccaataaagtgtaattatggtgttattgagctccttcccactttctcaaagccatgctataaactttgggtttctgagcagttacttcccagtcggtcttcattaagttgaattgtctcggaacaatgtctgtttaaccagcaggatgcttactaattttcttttttagaatttgtattaatgtaacaggcactgggtgactccatgtctcaggcactacacaaatacaacacagtgttacctctggtttcagaaggtcaagtagccagtgaatgggataacctggtcccagaagatcctccctctctcactccagcactgcccatccgggctggctatctcccctgtgacagcactgtgcacttcccacatataacaggaggattattatatttattataatagtgcactattataagtggcaaacgcaaggtgatttgttattgcctgtgtcactcaagacacctaaactctttgaggcaggggcttgttcaccgttgtcctttccaccactggctaggacagcgccagtcatatggtaaaatgctgattaacgaatacttcttgagtgattggaaggatggctgagcacacatcacatcatttccatgtacatctggtcatgcccagtagaaccactggacagaaattcaacgtgctcatagatccaaatagcagaagaagagagaaaataattatttttactgagcacctactatgtgcacagttttagcattggacaggacatggagagggccttgtgggtcataagaaagacttggtttgtacagattttgctaaataaagctgattttcaaagagaaaattgtaagaataaacaagtatgatataaaatagaggaaaagtatctgtaataaatctaagtaagatttctcaggggaggaaaaaaatcaaatccaattaggtattttcagattgcatttccatttcctttctgacacagatttctttaccttaggtattgactgtattttatgtccccacatcaatgaaatcatcttcagggaaacagtgtcctcagctcctcctgtctggctttgcaacattataaggagcatggagtggatttcctctctaaggcagccaatttcctaagcaattaaatgctgtttatattccaaactctatgcttgggttgaaattgtcaagcttgatattacctgactcttgcctaagatgtatccccagctagttcattctactgtaacagccatctattaaaatttccaatctgttctttcctcaagggatcacacagtacttggcaaaggtacagcttctgaattctgtaaattatactcatctatataaatatatacttttgaaatggcaaggcttgcaaattactttaccaaattgacatcccaatctgttatcctctaaaaggagcggcaaatgccacatacttcatacgtgcggagacacttctgtactgggttcttaaaaacaacataactagatgatacgcttttatgaaattcctccaggaggtcacagatcaaggtgcagtttttgtcacttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcagacacaccacaagagcatcagcaagaagcattccttggttacggtgcgggtatttcagtggcagctgcagttgattaaggattctcaagccctggatgggggatgaagattggaagcacagcacccccgctgccacctttttttttttttttttaaagcatagaatgtcaacttcctatcttcctaaaataggtgttaggcagcttttcatacattttttttagtgaaaacatccaatccactttatacactgccagcaatacaccagctatgttctaaaacacttgaaggatcaatcacatccctcttctcatcagaaatctgttaatggcttctccactgtttatggaataaaacccaaatccagcaatagccttcagggctctgccatctggcccagactgccattccagctttacctcactctagaaaggcagcttctatgctgaattcctttctgcttctgtgggtttttattcttaggtctccagcctctaactagaatgcctttatgcctctttttatcctggggaaaaaaatcttatttattctgcaaatttcaaattatgcctcctctataaagactttcttgacactttcatcaacattatttgcactggcccctgagtccccaaagcatattgcatttaccttggttgacaatcatgccattgacttggtattacagttaattgtttatctgtagacacctacatgtggccaccaactgtgacttacattctctcatcaaatcctgacagtgctcagtgacctcaggagggtctgaccatcatttgcctgtaaaatgcccatatgttgctcagctcacacaactttggtcagtaatagaactgaattcacatgtcatcctaacttcaaaatctggcatcactgtagttcacgggggcaggtaccagagccttcctatgtctttatttcccacagcataaaacaccagggagggcctcagaaaacattagaagaaataaaacatactctcttctcttgctagtcatcctgtaaatgttgcatgtgtcccttcaactgcatctctgaagacagggatcccattctatgtttcttttctatcctcgatggaccctagtaccatgtctgctgttttgcctgaagaaggctttaggagtctggtaaacatgcacactctatagagctggaggaacactaagaacgccccaccaatggcacaaatagttgctggctcattaaacactgggtcagaagataatagcctgctttggggacctttctgtcccctcattcagtgagttttgttgagtgactgtacatacacttttatggagaacatgggtgagcattctggaaaggggcaggggtctgtcccaggcagaagatgaagcccaggtgtctgcagcttccaggagaccccccagctaaccccaccccagctctgtaaagagtctgtgcttacaccagactcttacagccttcttaaggcatagcagacattgtgctgaagggacaatggtggacgcaggagaaacgcacagggttccgtgtctggggatccctgtggaggaagaaaagccagcgtgggtggcccatacctttcagcttttcagccagcagagcggcttcgtgctccgagtagtgcattatggcaggcggggatgggggcctgagccggtcctcctccagcttgcgccggtgccgctcctcccgggcacgcatcctctgcttgcattcccactcatagaagtcatccctggcctgggcaaagtccacatgaaggcggcctgaatcctttttgtcggtgctagaccctaatcgcatcctataacctgaaaccaatggaaactctggtcacaccataatgtaacaatggccacagttttggtccagaccttcaaggcacgcttaggcaaatgctcacttatttcttggctgtcactacggatacatttcccataggaagcgggaaacaattatccttttccccagcaatcttgaagctctgtaaagttaggcctattacaggtttggggataaacacaccttggagagctgtctcagagggctgcttacccatcttccaaaccagtatccccaagagaagatgatctcaggaactagggtcttatcatgatcattccttcttctccctggcttctaggaagctcagaaacaaatttggcatggagcattttttttctctacctttttatggccttggttttattatattttcagcttactataattctactgtataggtgaaatatgagtaaataaagagcatctatgatatttaaaaagatctacaaagtgaattccagacacctcactcacaggttattgctacattcccccagaaaatgctgctgctcaattctctctcagcagctgcaaaagccacaattaccaaggcaattttgcaatgctgttttatttccacttatcctctggggtgcgcaggagaatattttaccttcgatcaagaggcctcgccgctgcctgcctcacagccctgcagcacctcatctggtatgcagcaccacacaaattgttcatgtaatattttaaggccacagcagccccgtgcaagagcccagagctagacaaagaaaaaaatgggcctggaaatctttgggggattcactgtgagctacccaacttagataaagattatgagcagaaatttgatctgagagatcaacactaacagaactgaaaccagtcagccggcctaacttcaaatgaagaagagttgactttgaggttgctcttcagtttggggtactcagattttcagaacataaatccaggtcccagcagagacacagctgctgggggctgccagaggagagagcaacataagcacttttccagtatgggggctttgcaaatgagatacaactgtaaaatgctaggctgcactgtgctgatgttcaagatctcatggtagatttcaatggattattttagcacttggggataaacctcagctgaaaatctctgtagaggctggctcctccccaggatgccacttcacacctttgaaaagttacaaataagatattgacttcacatctggtttctgtgatgccttggaacccttctcactgctagattttcaagtgttatctgaaaatgggaagacataacaataccaatcaaaaacaaaaacatctaatcacagatgtgcagaattaatgcaaaagcaaaatgtatcttggttgtgggccatgggaacttaacaagtcagcaggccacagtgatacacgcataacagctgagcaggcaggactgtttaaactggccagctatcccaactggccaagcacctttcccctgctcatgtccagagaagcagttttcaaacatttctggctccagaaacaccctcactttcacagaaacatcatcattaaggacttaaaagagaccctgatgaggctgagtctaaaattagctaggccttcaaacgtgaatgtggtcctaaaattagacaggccttccagctgggcttgggcttgggcttgctggagcccacaaacaggaggggccgcctgacttccttcctgcctttccagttaattggccttgcagatcttcctgggactgacgctgcagcctctcaagggcagggaggcagagttaggaggctcctctgcacccaggtagggaagctggaggtgaggcctagctgtcttctcctcctacagtaatggggcagaccaaggagcaatcagagacttgctgagagaagcgggaccagcacccaggctggaaaatcataggatcaaggtataatcaaggagcacctttcatatgcctaaatttgggactgttcatctttgtcagtgtcttatgaggcttctgattgggtgtgaacattgtgttgtattagtgttgaaaagggcctctgatttactctaaccttctcatttaatcaagtagggtaaagaatacagttgacctgtgagcatgggtttaatctgtgcaggtccacttataggtggatttttttccaaccaaatgtgtatccaaaacacagcattcgagggatgtgaaacccacatatttggagggctgacttttcatatacatgagggttctgcaggatatacatggggcgggggcggggggtcctggaaccaatcctccaagtgtactgagggatgactgcagttttcttggtacagctgtgattagaagccaggtccccaggatagggttcttgagatagaaaaatccgtccttctttatcatcatcaggatatttgtgttaaaaacaaccatttcctgaatggtttctatgttgcaggtgccctgctaagcacttaatatccattatttgatttattcctcctcacagtcctacgaggtcatgctgttactatctttattttatagatgagaaaatggaggcaggctctaggccgtgaaacccagtgccacaaactcaccagaacccccgttgtctaacagcggattgtgtgttatgaaatgtcttcattctaggctttgtcttccttctccattttgtattgcttttagtttttattttctactttgtaaggttttactgaaataaggggttttaaagttctccatatcactgtctaccttaggaaagtctctgcagtattggaataacctcaagtcttctggagtttgcacagaatttcgtggcaatagaggtggactgcagaaattaagtaaaacctggcaggaatgctcagataggtccccctgcccctccccacccccacccgctactgttttcccacattcccccatcagctttgcctcaggaatagggaggtgaaatgcagagggacagactgaaaaatggaggtggggagtgtgagggaagggcagtgagttcagtctgagaatgtgtccttccaaagccagcccctaattcttgggtttggcaaaggccttgcggacagactccattcacttggcccaatacccacagatgggaaggcagcactaggcctaatctcagtatctgtaaaaatcgcctataaaaattgacaccagaggacaaggcttaatgaaccaccaacgaggcaatgatactgggccttctcctagggcccctaagctactttcctgcaaggaactgaccttgctttggtaccttggtgtccagaaagtgaatccacttccaaaaacctgaaattattctgagagagtactttactcctcctaaggattacatccagtaagaataatggtccttagtactcataatattgcttctcatctaataagcacttgagaacattaattagaaactcgatggaattcctaaagactggatggtgggaaattgctcctgcagtgaagtaccttcacaggcttagcgcagagcttctggcagccaaggaagaaggcagaattcctccttttccagccccaaactatgaagactttattttgcatgaaggccaaagggaataagctcatattaacatcacaaaacataacaaaatgcctagaaaactccttatgtaatgcaaagtaccagaaaggtaaatggctttatcaaccatgaattcctctgcaaagcgaatgtgacaaaaattcttcttgcttttccgaattgctgtaatatcaccgcactgttcaaagacttcttgaataatttcctcagtagcattttctggtaatcctccgacaaacacggtcttacacccaggaggtcgttctcttgtggaaggaggtggaagatctaataatcacaacaaaacagaaagttttatctttcatttatttgctttctctggttctcctggcaaaactaaagcttgcagagtaactttctccagactgagtgacggtaaatttctatgccaacttaacattgatcccaggctgtcttgtttctaagttcctctcccctcctgctcccaacctttactttctgtgttcattgctacacagagtggctatatgcttgtccatgaacaaagataaagcaaatgtttgcataatttcatttctcctttatactacagaagcccagaaaagggagggaaaaaacttcccaaagtacaaaacatgacgaaatgacaacatgatgaaaaacctcagcgtgttatctgctttgtcttgtttccagataaaggagcggcaaaacagaatacgggaagcataacctacaaaagcacgcacaatacttacttggctgtgaaacaccgggcctgaaaaaaaccactttgttattattcacatttaaatgagcaaactattaaattttgggaaggctgtataaaaagatacaatgtacactctcacaatattttacctagtttatatgtagattactaaagcaatctcctgaaaagtccacttaaaaaaggcaacactgattaatatgaatgacaaaaaaaaaaaaaagtcctagctcttttagcccataaacttagtatctgaggcaaaattaaaaaaataaaattctggcccatttacttcatcaaatgtatgtttccttcaagcaaatacaatttggtccagaaactctgagatgcaggcttccctctccccagcccccaaattgctaactgtcaaattaattccattttccatctagcaaaacatatttcagagtttttcacccacatttgtgaagatggatggaaatgctcacatatttcacactgtgttctccggcaaacactaggcttcactgcatgcaaaaagtcttaacgctggatacacatccctaaatcccacatactggctttatagtgtggattcagcttctggacagacacgtggccacatccctgtatatttattgtaacctagagacaaaaggccttctgtagaacggatccccactctgtgcatttacgtgtgagtcacatctgaaaatgactgcaatgccattttaaaatttaaaaagaaaaacatttaaaatgagcaaatatttctcataggcgttacttacttggattttgaggaaaaagagtacagcttttgcagtggattatttctttgacaacagccacttctgttggtggtgggggaggtaccagtccaaggcctggtatcattgggttaatgggggtgattccagtcatcatgttgaggcttggatcaaagcctgggacacagattgagtctgtaaagtatacaagataacattttgactggagattaaatccatttttgttgttgtttttgccattttcctgtggattatttgactttatactttctatttttcaggaatttctcctggcataagatataatattatagaaagctatgccagaagggtaaagagaaaaaaagtaaaagatgaacattaaactacatgaaaaggaaattatattacttaaaatattaacatggcagaaagaacacagcatattaaaatgtaaaagcatgcaccatgaagcttcactattactgtgaatgcaattttctatttcttaacgttggtgtattgtttataccaccttatgacccagaatatgggaagaatatcatttaacattgaagtgctctgtgaatctaattgtcaacgtggtttcatcaaaagagccttcttacccaagtgacctagatttaggaaagttcaatttatatgtgcatactttataatgatgtattcaggtcccacctaacctatttcccctggaataaaaaaaaaaaaaaaagcaaaacaaagagtgattacaattactatggctgggttagatacatgcaggcataaaattagctatatacatttctggcttctattggataattgcactttcttcctataatttagtcaacaaagaattgacccacccttttgaaatctttatgccctgtattacacacacacacacacacacacacacacacacacttgaaaatagaaagtgtgcaaaacaaatgggttttccagctttttttttttttagtgtgataatgaagcaagtgatttcaaaggtggcatacagacactaataagtaagacctttctaacagcaggggctatgaaaatactatactgagtagccacaaggggatcccgttcatgagggtttccctgttggcagaaaagtctcatgggtggcgtgaaaatgttcccagatagacaggccaggatagatcatggtgccctcctctactctgcaaggatgaaacttccttcttgtctcataccatcctatcttcttctccctcctcatcttacatcacttccagtcttccttcctgcccgccacccctgcccccgacaacccctttgtacagttctcctgtacagcctgtgccttaggcctccgcatggcctcactcttcgcttacctgtgctgaaaggctggaggagcccagaagcagatgtaagaataaccacacgctttgtttactaagaagctccagagaatacagaaggtctagcaaaagcgtttcctttctgggaaaaggtttacagattccgccagctactttggacatttccactcctcctctgggctgaacagaataaacaatgtgattctgatctataaccccaagaggactgctgtcccatttattaaaaactccatttaatttcatagtgtatcagtgtgacttcagtaaaaggaggatttttttttaaaagaaaagaaccctaaatataaatgacaaataagcattttctttcaaagtagtcaccctgacattctaggtacttcctctacaattatggctctcagtttcttcatctgtaatatggtactgtttgactggattatctcttggagtgctagaattccaagactccaggattccatgctgatgttgctcagtacaaactgacacacaaaagacttaaagttttataagtgacagagatgactctgtttattctgtcaatcatcagaaagtttcacaagtatgatttccattttacagaaaagaaagtaaggcttaaagtacttaagtaaaacttctaacattccaaatcaaacagatggcagagtcagaatgagggcccaggtctttgcctcagtatttaaacatgtattaaatgtgactatttcaaagtttccatctagaatgacccaacatgattactcatctaatacatgccactacttcttaaaatgtactttacccttaaaaaaatcaagatgggtcctgccgatcaattctaaagaagttccagaacagaatggttttcaacatcatcatcattaaaataacatattggcctccaaggtgaatatattagaaaaagaaatattggcaatgggaatattggcatgcttgtgcttttatttaatctcattccgtacatcggcttcatctgtttttttcctggcctggccctcgctattatttgccaacacaggatgatttaaggctgaaaccactcaggactgcaaaccctgaaatgagagccctgtgaattataatcagcagatgtttcccacaaatgagaagagaagcccagtgcttgcattctctttagttgttaacagacttctgttttctttctgaaggctaagtaaataaatatatgtccagaaatggggacagaagataccactcttgtacaacgtattttaatatacagcaagagttgctttgcttttttctgagacatcagtatgaggagactatgaggtttaatgaaatctgcatggcaagtgcagtagcttgaaaagagcttagaaaggaattaacacgtaaattatgttggacctgaaaggattggagattcagtatttgagaggagaaagtaaggaaggattagactttaagaaaaaaaaagaacccattacttttttaacaatatatgtaaagatggaaattgttttctctaacagcacaggagcatatgatgtactcgctcattaaagcaaacgcacaaactgaaaatcgaggaagacacaaacacaggaagacaaaggggagaaggcagcgcaacccgaagaatcagttccatgccctgttaggaaaagctgcccctgtgagcttcagagataatgagttgtaattctactcagcgcaaagaggaggactgcttaaatcacagcaagaaagaatccaattacgtatacagtagaactttatcacaactgtactgaaatgacaggaaggaagggttattcatcacagaccgtggccctgtctggctcctctctgtgttgccggctccaagcagagactggccacagccaaggctcggcaaaggtttctttttggttgtctgttcccagttggacgagatgaaaacaaacaaaaaaaaatcctgtttactgattcacaggccagtgttttatcaattggatgagcatttttcagaaggcaggttggggctttgtgttcaggattttagaggcatggcagttgaattaattaaagcactcattcatttgaattaaagatccattcagcatttcctgggcacgtatgactgccaggatctggagttacagaggtaacagtagtaagttccccacttgagtttgaggagaggataaaggatgggaaccaaactcagcaaaagagtcgggacacatgagctgaggctcagaggacacagagagagtccaggaagggaattgctgggagagagcctggtaggcctggggaattccaaacaatttttcatggctctttcatggtgtgcatctggcagtgtggccacaatgtctggagagactgcaggaattagatcagatcagagagaccctgctgttcaagctagtgaatttcaactttgctctccctggaactcagagtcagagatgcaccctgccaggccagggctccggtgcctgggccgcccttcctcacttcttctctctttgtctgctgcccgctagccatgccttgctccttttctgccctttctagtcaatgcctcagttaagagtctcatatttgagatgagaactagatttcatttgaaagaaaggcagttgaggcctcttgccaggcaaggctgggcatactaactaggttaggtgtgggcagggaggagggacagagagaagttgtcagtactaggaacaagtctggtctggaaggaagaacatagcgttttaagaaaataataagagaaagaggcagtaatcaggctaaatggctgcattacaggtgtagtcctgggctgagggtgtcctgacaaagtggctgaacacagagattattagcgcagataaaacacaggtccaggtggggcagctgcccagaggactctgtctacaggtcacagggcctgcaccccctggtccagggttcagacccagcccaggggaaataaagtttgcaggaacatcatggagtcataagttgagaaatactaggccaattggcaggttacctaagccaggattcaggcaggagaagcaagacaggattcagacaacaaaatagaagcctggggtttggggaaggagatagacccctcagttatcagatacggagcacaggtcacagcctgaccagcataaagcctgcttggatgctgagtcttagaatgcagggctccagagcccccttcctcccgcctgacgccagatggaccctcaagtccagggacagagtaagtgtgtggggccaggtcccaggacttgtgcagggcacagagacaggctggaagggctctaacaaacatgcaattgtgctgcttctttttccagaattactgggttaaaattactgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcattccatgttttcttttttcaagcattcttaaaaaactgttttgtgaacagcagaggaaaagtgaacattttaaaaaaggtgatcttaaagtcaagggatctggcacagctggatgacctaaggctgaccagctttttttttttgacatgagtgttgcactgtcatccaggctggagtacaatggcacaatctcagctcactgcaagctccgcctcctgggttcatgccattctcctgcctcagcctcctgagtagctgggactacaggcgcccgccaccatgcctggctaattttttttgtatttttagtagagacggggtttcaccgtgttagccaggatggtctcgatctcctgacctcgtgatctgcctgccttggcctcccaaagtgctgggattacaggcataagccactgcacctggccagctgactggctttttaacctctctgggcttcagtgtcttcaccaggggaaggagaacatgaatactagatagacatactggtcttcatggtcatccaagaagaacacctgggtgaaggcagtatatcaaagtgtggagacctcaagtctgcagtcatgcactggctgtatgactttgggaaatttaactaatcattctaagcctcatttataatatctgtaaaatgaagagaataatatttaccttttaatgttcttgtgaggattaaatgggattaataaaacaaaaccaaagtgttcagcataatgtccagcacatggtaaatactcaataaatggtagcaattacatacagcattaataaacattaatattatatagaatatttacataaccttatataaatatgttagtaacatagcagacacacaatcataatgatgattacaaagtctttcatttgacaaacatatgagtgcctactaggtgttgagtgttttgctaggtactctgcattcaaagacattgcaatgttcttccttcacagatgtggaaatctagtgactgaaacaacttagcagaaaataccaatacagtaatgacacttattttgagacatttaaataaaaggtgctatgaaaacactgaaaaggggacatctaaacccgtctggcatagggtttgtaagagttgacttgtgtccccccaaaagatatgttaattattattatacttttaacataagtcctaatcccccatacctatgaatgtgactttatttagaaatactgtgtttgcagatgtaatcaagataagattaggtcatactggattagggtaggcatgatctaatatgactgctgtccttataagatgaggagaaaagacacagacacacagggagaatgcaatatgatgactggagagatgcacctgcaagtcaaggatcacccaggatagccggcaaacaccagaagctaagagaaagacatgaaactgattcttccctggatccttcagtgagaacaaggccctgccaacagcttaatttcagacttttggcccccagaactgcaagacaatatgtttctgttattttaattcacccagtgtgtggtactttgatacagcagccctacctagaaaacaaatggggttgagggtggggggtggggtgggtgccaggggagtgtcagggaaggaatcctggagggggtgacagctgaccaggttcttgaaaaggatgacatctgtatatgcaatgggcatgtaaaaaggtatccccaaaatacacttattgggatcctaaatacaaagatatttctaaatgttctcttaggagaaatgttcaaaaccagtctcctggaagcagaatagctcttaggttttccctttgtgaaataaacaaactctgaagatggttacatatttgttaagaacaaattaaccacacagattatgttaacataacagaatactttacaaggtgagtgaatgcctacaaaccagatctttaagaaagtgaaactgaaaatgcttttgtaatctttccaaagagtttcaaaggcagtgaggtatgtttttcatttaaacctaagatgtgtatccagagtgagttcctggtgcctgccgtgcacactttataaacaaagacttcattccatcaataaaaccctctgtctcctttgaccaggatgcaacgctggcagaactgaggaatgcagctgtcaacagctattctaagtattgttgacttgggtgaggagatttgtgtccatgtttgaaaatatgacatgacacgaagcaaagagaatttcaaaactcctgaccaaagctggtacagagaaaaactgactgctcaaagaactccatcagatctttccagcaatctgtgcatggagcgtgcacttgaaaagcaagtgtgttttgagtgagcaggaggtaagcgctcatcacaggttctgtaaaattcactcacactgtgggccaggaactcaagggcagagcggtttctgtgcagaggactgggctgacacagtcagagcaagctgctccatgttttctggacctgctgaaacacactcttaagacacagtgggcctcacagctgagccatgaaaaccatgctggcatatgacaaccaggtgtggaggggttcattttgacaagcaggcaatggacactggccctaaccaaagattaggaaatttcaaagcagaaagcaacctgggcattacctagtcctaccatcttgatttagagatgagaaagtggatgcccagagaagtgaagtgatttgcccaaagttacacagctagttaagaggagagctggaattagaatcaagagtcctgctgcatcttcactgtgcacctgagttctctgtctctccagcatgccttcctttggatgcctctagtgacactgcactcactagctcctgacattgcccattcttttttttttaacagttttcaaagtgagaaatttatccctaatatgttgacttcggacttgataacctgtagttaaatccattgtctttattcagtactcctgggttcctgtaacaagtctgattctctttcccactgttcctggtcaaatccataaagaaagcacacaacaatacctgaaccttctcccagtcagcctcagcaccctcttccttcagtccttccatgaactaaaatccaccttttctgacatctaaaaattctaaaaacccaccttttctgaggtccagggttatccacagaaagagaccaggaagaagctgatcaacctattaatggtggtctctatctttcttagttctgaacttgtatgtataaattttagtaagttgttacgttacgattaaaaagtaatggtcatgtttactccttgctttgtgacaggcctgtgctgaaagcttcatgtcatctcatgtcatctttttggcagtcccatcacaaagttgacaaatgctaagtgacctcattctactaaaacacacacgtcttgtctgtctgcagaaggatactctcatgcaactttgaagttgacattttgaaactaaatgaaatttgcattttccgttcagttttccaaaatctgtcttcttagttctcctcctgtcttgaatttctcctcccttgtcctcaatagctataatggctagacaaccctctcttaaagttcctgttccttctaattcaccagcaaatttcttcttgcaggacagattcagccacagagggcaaggagatcctcctgttgccacatttggaaggtgaaccattagctgccttcctggcagatgcctactgggggtctggagcttggaggtgacacatggagcatgtcctcctccacttcctccctctgtccaggtagttgttgttttgctctcaccacagcattatttctgttctttcccctctctaccttcaccccttggtgtgcaccaggttccctgcaccctcaggtttgtgaactgtagcacgtgcttacagaaatatcttcttgggccgggcgcggtggctcatgcctgtaatcccagcactttgggaggctgaggcaggtggatcacgaagtccagagatcgagaccaacctggctaacacggtgaaaccccatctctgctaaaagtacaaaaaattagctgggagtggtggcgggcacctgtagtcccagctactcgggaggctgaggcaggagaatggcatgaacctgggaggcggagcttgtagtgagccgagatcgcgccactgcagtccagcctgggcaacacagcgagactccatctcaagaaaaaaaaaaaatcttcttaagcaaatcttcttagactccctccccaacactgatttcttctgaatcctctgttgtaaatttccagttttacgggccattgccaggtctcagggatgtacacagggttaccgtcaattccttaggctggaagctcatgtgtactaagttattttccctgctccctctcactcatttctccatcttgtctgaatgtactccacagcaaactgcttacaggattctgggcatctggcctactctactcctgttagacacttttgggttaagtaactttagggcttggttgtttcttttaatggcaccactcctctcagtcctggtttaaaacctctataggtaaccacatctagtgacctgccaaaccctttcagatggagccactttagaaaggatttctatatcattgtcttttttgttcccattgctaatttaggtcctcattcgctctcatctggagtactgcaaaggactctttttgtccccacaaactgtagcttctatatcccccctgtccccaccccctcctgcccttcctccctccgcctcctccctgcatgcccttctcacacccctggaactgggatcagccagcgatgcacacgggggaaccatgagaacaggccctaattggggcctctaaattacttctttcagacttcttttcacatccctatctcattagccgatgattaattttctttctgtacgatgttatgtgactttgtacagcaggactgttatataatgatagggagggagaaaaggactgaattggctcttggtgttctctgctttgtcctagctgacaagcttatggtgcgggagcagacagtaggggcaaaaaattattaaatattgagaaatatttttgaacattcagtcaagcccctaagaagtcgctaatttttatacatctacttctatctttctgaggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaagaacaaagaaaaacattcaatatttagtttcaaagaaaacattcacatcatattaaacaatttatgtaggtttcaatttaaacttactgcttgaagggactgaaacaacacagaactggtctgtttaaataatatcagtatatagctgtagactgggagagacaaaaatagagcctgttttaaaggtaaacacatcatgaatattcctaaagagaactgcaaattgtgtgtggtctgtaaatcatagactgatctaatattaatttaatttttctactagactgtgtgggcaaggagaacgggtaacataactatcacttatctcagggtccaacatggctcttggcatatagtatcctcttcaacaagtatcagttaaatgaaagaaagaaattataaaatttacagaatttacagagttcatcctaaagagacaagacaaagtagtatttggttgttgagtccacaatgtcacaacataaattcatatatgattctaagcaaatgacatgtggtattctttctatttgtcttattaagtgaatagtaagagccatgagggttcttgttagttattcctttattatagttggaaaattatggtgatgatgacttacatttcacagataatgaggctaagaggcacaaggaatgaaggtgtgttcacagaataaatggacagaattggtctttgaatgcttgttaatatggcatctggaaggcagacctcatgcttcccttcctttctagctacaagaaaccagacctgaaatcaaaggataacacagaggggcagtagggtaagtatggtctcatctaaatccacacaaggtcatctcataccacttagcttgggagtgcttgaaaaattcaggacaggaacagggacaggagaggacatcataatcccatgcctcaggggaatactacaacctaacaggaacataactgaaaggcaagctaaccaaaacaagtttacaaaagaggcaaaaataaaatttcactcatctgctattaaaattttaaataggaagcataaaccatatgaaataaactcaatcttcacttctatattatggtgaattagtgaattaagggaaaaaggaaatacaggaactgtagattctgagtagagattagaaataaaaggaagaaataaagttgaagatgaaaagaaaggaagtaagtcagagggagagacagcagcagacagatggagggaccgtccgagttctagttcaagggtagactaacagaaactgtgcctcggttcttcatctgcaaaaaaaaaaggactaaaaagagtatttaccctgacagcattgttctgaggattagtgttacgaattaaaatatgtacaaggcttcaaagactacctggtacagagtaagcactcaacacatattactatcactttgataaacattatatcatttgtgtgtgtgagtgtatgcatgtgtatattagagtgtacatgtgctacaagactgctttcatgtccttcctttaaaaaaaaaaagcatatcctacttctcggtggctttttaagttcatgttttattatctgtcctaacttctttgggtggaaaccagaaggccttctaggaaaacaactgaggagacagtgccatacagtttctctacaaaagaaacttctccaagggaaatcagaaacctcctctttcttctcccccaggacctaagatatttttcatgcctggaaatgagagttgcagcattgggacctgtttcctctctgctttttctgccaggaagattaggtgttgtacccgacacaccaactgcacttgttcctatgtttggcatacccactttccccttaaactgagttttccctttgtaattctattttattcatccaaatgattatgtctattttgagcttttttacccacacacatacacatacacacacgtgtgcataaacacacacacacgtgtctttttaataaattaaaactgagcagcaccagacttttaaaaatacttcattacatccgaggccctggccagatttacttatttacatgttgttttgcattttaatttagaaagcaccaatgccaacccatactcccccatagcttgtcatttctgacaacatcctgagtaattccaggggcgaatttttcagagggaataatttaactaacaaattgccatttaaaactaatttatccttttgagctgagtgcaatatacttggaggagcattccttaatgacttgtttggataatgtttttctccacagtgttgatccctcaacattagaaactcagagagttaattcctcacatgaaaaacataccccaaacttttcttctggaaaggtcaagatcaaaagcagagactatcccccagatttttcattttctcccttcccttcccctcccttgccttcccttcccttctctcccctcccttcccctcccttcccctcctttcctttcctttctttcgcagagactatcccccagatttttcattttctttccttccttcctccctccctccctttctttccttccttccttccttcttaatctttcttttatcttttcttttctttttttttttttggaaacagggtctcattctgtcacccaggctggagtgcagcagctccatcacagctcattgcagcctcaacctcctgggctggagtgattttcctgcctcagcctcccaaatagctgggactacaggtgtgtgccaccacacctggctaatctgtatattttttgtagagatggggtttcaccatgttgcccaggttggtctcaaactcctgggctcaagtgatcctcccgcctcagcctcccaaatgttgggattacaggcatgagccactgtgcccagaaaggatttttcattttcaattaagtattttctgcccagttataacttcaaagaacgttaggtacttcattcaggggtctatatttcattcttattcacagaagcatctagttttgaattgttactatgcttttatgcagtgctatgttttcaaaatccttttttagtcatttaaaaagctggtcctcattatatctccaccagattcttcctcctccacagatgaaaaaggaagttgaggtttggcagactgaagacatctgcccacagtgtcactggaatcacagggaaataggctgtggtttacactatcctgctggggatgaaaatctacttgtttgtagtctccagggtggtaaagagcagagggggaaaagcaggatgcacagtattcagggtttagctgaatgtcaagttcagcttcctcatctcagatgtgaggctgcaacctgcctatttacttcacgttgttattatgagtgccaaactgtatgatggacgtttatgtgccagcaatttacaaacaagcaatcaatacacaaatgtaaattatagtcagcattttttcctattttggtggcttctgagactctacaatggtgctaagtgcccaccttgtccagaaagagaattcaatatattcagtgtattactgtgttttaacaagtatacagaagtgtgacaggtgagagggacagagggagaaaaagaacggggcggggggtgagtgagagagagagagatagtgtctatgtatgtgtctatcctcgatgcttgcaatccatggttctcagcagaactatgccattctccatgttagggtcagccagtttttatagttggaaaaactgagaagcagagtggcatactgccctaggtccttctgagatatttgctcattcaacatgtattaattacgtacaagtttgctaggcaagacgctgggggcatagaggtaagtcaggatccctggccctaaggtgcccccagtccgtggtgatgcagatacctgggcacatagctgtgttagaaagtggcagtgttattagcaaggcacacaaagtacctatatcatcatcctgaaaaaagcctgaccatactctgaatagtatgtggacttcctcagtgaaagtatctatctagctaagccactgtatccccaaagccaagcacagagcattttgtaaatacatacccaggtcagagagtggctaccccatgggccccagccacactttcaatagcagtcatttttcctgcatttatcaaaagacattttggaggcagaggattgtttggtgttgtattatttatctttatctatattattatttacctttctcctcttcctaacacaggaacattccagatcggtaggcctcttgcaagctgagtctataccaaaagtgcacacgttgtggaagactgaggttataaaggataaatctgtcacagagacagagtacaagggctggctaatctatatttgcttgttgtaactgaacagggaatttacatttgccagaatagcagaaaagaaatattagcttggacattcatgcccttattcaattatttttttttactataaccaaaacagatcttcatgttttttcaaatacatttggtcagtcagtcaaaagaatttgaaaagcatatcacaagtatttaacttccttctatcagagagtgatgggacagagacatgagggaagtgaatcatttcagcataaagcttttgttaaacagagctaagttaaactgaactaaaatagaataaattggatgtatgaagtgtgtattatgggaacttatcctgagacctcttctgttcagtgtcttttcttgatgtcttgaacaaagattgctataatacactcactaaatactcaccatcatcaagttacttgtgttgaaggcatgtcaggtgctaagaacacagaaaggttgaagacaagtgtttaggcttcacgcttcaagagggacaggaactttcagagtaaattaaagtgacaaaaaagtactttaagttattgaaaaccttgctaaaatgaaattaaagagctgaaactctacccagagttatatgactgacacagtcacagcagattataacagaaagtcatacatgtaagaggtaaatcctaattccacaggataatgtcagagaaatcaggtcctatgaagcatccctcacactgttccccttggccaccatctgtcaagaagtggtaccaggccagctcttgttattaccataagaagcagagagatatgagttgggaggatccaggtcagatggactcctaccaacctcttccaattgaaatccgggcacttctaccctggcctcacccctccacaccttgcttggctggcctgccttgcactggcctcacctgtgaccatgcactccagctacctcttggacagactttataccagcctgaccagaaggttttcttagctatgatgttcactgcccaatttttccttttgtccctgctatagtctgtattataaatttcatggttagaaatttaatgttgccaagcattaagaggtgaggcttttcaaaggtgactaggctatgagggaggttatgccctcatgaagggattaatgcttttaccatgggagtggattagttattgtaggattgggttagttattgtgagagcgggctcctgataaaaagataaggtcagtccccactctctctctgtctcacatgcttacttgcttttctgctttctaccatggaatgatgcaacaagaaggccctcaccagatggctgagcagatgctggcaccatgcccttggacttcccaatctctagaaccatgagccaaataaatctcttttctttataaattacccagtctgtggtactctgttatagcagcataaatgaactaagatactccccacctcacatttgtgattgttttggatcgttttcccacgaacaaaactcctagatatgatccttttttttcttgagtgaattaccctctgagtaaaaatctagcctttgggactccagatgaattgtggaagaaggtatgggaaaaggtagagtaattattttaaccaagtattataggcgccaggcaaggtgctaggcatttttgcataccttatttaattttatcttcagtacaacaaagcaagggaagttaagatatggagaaagtcaagtgtcagctagaagcagaagagtaggaactcacactcaggtcagttctattgcaaagctttttttgtctcaccagagctgtcaatgataaaaccctaaattggatggattatagggtctggccagaacacaggacaagatggatctttagctggtaaacaccagtatggccatatcactgttttaggccagcatctgttctgcttggtcagtgcccaagacctatcatttgttaaatatttaggcatcattgttgcccatctcaaaatgaaatgtttgccaaataccaaatgtttgacttttactctggcaaggagagagtaacagtgactggatatggtctcccacctgaaacaactaaaaagccagataaagtatatgaaacatggttttcagatactgggcatgaggtaatgcaagacaatgattcatgaaagaagtaaaacaaagtgagccatatgattgccccagcttattgccaggagagtttccgggctacagcacagggaagaggaactctggaaaagtctgacagtctctctgagtaaagaaatagttggtagtttaggatggcagcttagagttcatagggtaaagtaccagagagaagagaatagcacacatgtgtgcacacaaacacatctctccctggagatataaagcaagtcttgagttgagaactaatcagtgtatgtgtgtgataaaactacactaagctaaagaaagaaacacccaaaaggtttagaaggaataatccataaagattacaaaagactattctcatcagttagagtagaaaagcctcataattcatgatgttattgggtagaatactcagaatggtatcacctttgtagtaggacaaaactagccctagacaaaaagctgctgtgatctctcataacaaaacttaaaagcaagcctcaaaaggttcaactgcttcccagtaacttaaatgggtcctaaaataaacttcacggatatgagaatacaaaaatacccagcacctagcaaggtaaaattcacaatgtctggtaaccaattaaaaattaccaggtatgacaggataattccaaaacctctgaatatattattttacatgtcaaaggaattaaggatacagatgacattaagattgctaatcagctaactttatgacagattattctggattattgatgggggcacaatataatcacaagagtcctaaaaaggggaagagggaggcagaagagaaggttggagtaatttgatgtatgaagaattcaaccctccattaccagttttgaagatggaagacagcaatgagccaaaaaacataggcaacatctagaggatggaaaaggcaaaaaaacagattctcctctggagcctccagaaagaaatgcagccccgatgacatattgattttagcccagtgagatttgcatgagatttccaaccacagtactacaagataataaatttgtgttgtttttaagccactaagtttgtggctacctgttatagcaatagtaaaaaatgaataaaaagagaaattacataccaggcatacaaagaagcaggaaaatgtgaccaataataatgagaaaaataaaacagtagaacaaaaaaataaataacacatagatgacagaattcgtagacaaaaatattaaatattcataactgtgttccatgtgttcaagaaggcagaagggagatttaacatattaaatagagagatggaagattaaaaacagactcagaatgtacttgtagggatgagaagtacaatgtatgagataaaaaatatactgtatgaaattaacagcagatttgatgatttatttaaaaagttagtaaactcaaagaaaagcaatagaaactattcaaatgaaacgtggagaaaaaagacaacaacaaaatgaacagaacataaaagggctgtgggacaactgcaaggagtctaagatatttgtaattaaattacttgatgagggtggggcaagaacaaatatttgaacaaataatggctgaagattatccaaatttgatagaaactataagctcacagatctaagaaactcgagaatagaaggcacaagaaacatgataaaagtatatgagggaacatcataatgaagttacttaaaatcaatgataaagacaaactcttaagagcatccaggaaaaaaagacatattacatacagaggaactaagataaaaataagagtatatttcttgttggaaacaatgtaagccagaagacactagaatagcacctttaaagaactgaaattaaaaaaaaatcttttctttaactttttctttacccagtaaaaatacctttcaaaatgaaagtgacagaaaaactttttctgacataataagctgaaacaatccatcaccagcagatctatactataagaaatattaaaaaggaattcctctaggcagagaaaaatgatgagctgtaaatcttgatctacacaatggaataaagaatatcggaaatggcaaatatatggttgaatagaaaaaaaaaatttttacttatttttgaactctttaaaaaataattgcctgaaaagagcaaaaatactcacaatgtattctgggtttatgatatatatagaagtaaaatataagacagcaaacataatacaaaagtatatagttcttacaatatatatgaagagataagccaacaaaggagataaaattgaaatcataaagatactaagtccaaaaggtggcagacaaatagaaaattggaataaaaaacagaataaataaaatcaattattaagattgattttaacccaatcacactgataatcatattaaatataaacagtctaaataaatatccaaaggcagagatcaatccaatatatcagattggatataaaaactatatgctacttataagaaactcacttttaatacgaagtcataaataagttaaaaataaaaggactgaaaaaaatacaccatgctaacattaatgaaaagaaagctggaaagggggcatgctaatattaggaaaagtgaatttcagataaaaaatataattatggataaatgagtcatttcataatgataaagaggtcaatttaacaagaaaatataacaatcccaaatatttattcactgaataacagaacttcaacatatatgaaataaaaactaataaaatggaaagctgaagtagatgaatccacaattaacagtcagaaatttcaacaaccctctcttaataattgctagaacaagtacatagaaaatcagtaaggatataaaaatctaaataatatcaaccaatttgacctaactgacatctatggagtacttcacccaacaaaaccagaaaacacattcttctcaagattacatgggtatatttatcaagattggccatattctgggcataaaccaaaccttaataaaattacaaaaacacaaatcatataaagtgtattctgagaccacaatagtattaaattataaaatagtgatgaaaaatatctagagagtcaccaaataattagaaaataaataacacatttctgaatagcctgtaggtcaaacaagaaaccaaaagggaaatttagaagtactgtgaattaaaataaaatttcatgatatgcagctaaaacagtactttaaaaatgtttaaggcactaaatgcttatattagaaaagaagaaaggtcttacatcaatgaccatggcttctatcttataaaaaaaaaaaaccttaaaaaaaaaagagcaaattgagcctgaaataagcagaaaaaaaaattaagaacaggaattagtgacatagaaaaactatagagaaaatcaatgaaaccaaatgctagttctttgtgaagatcaatgaaattgataaaactccagccagccttaggcaggaaagcagagaagatacaaactgctaatattagacataaggaatgtaacataactacagttcccatacataaatatcaaggcatattacaaaaattgtatgtcaataaatttaacaacttggaatagatttcttgaaaaacacaaattaccaaagctcattgaaagaaaaacaaataatctatatagctctgtatctattaaagaagtagactttgtagttacaattattcccacaaggaaacttcatgcctagatgactttgctagagaatcctactctagtagaggttaaatcttaaggaaaaaataatactaattctacacaaactcttccagaaaattaaagggtataccttccaatttgctttatgattccagcattacttttgttacttaaatcagataaaaacattagaagaaagaaaaactatagacaatattcagcatgaactttgatgcaaattctaaacaaaattttagcaaattgaatatagtataatgaataatacatcatgactgagtagtttatcccagagatacaaggttggtttaacattaaaaagtaattcacgtaatttaccaaagtagtagactaaaaaagagaaacacacacacacgatcatctcaatagatgcagaaaaagcgtctgatgaaaatctgacatccattctctcagtaaactaaaaatcaaaggaaatttcctcagtaaaggttatgtactttaaaactacacatatgatcatacttaaaatggtatttcttcataaggtcagaaacaaggcaaggatatccactctatttctattcagccatcaggatatatgacaacatgcgtgactttcagaataactatattgagtgaaagaaaccagaaactgagtacattctataggtttcatttacataaaattctggaaaatgcaaaataatttgtagagacagaagatcagtggttgtctcaggatggggatgagtaagaaagggggtctgagtaggtaggaggaagagataacaaagggaacaggaaatgttttggtgtggctgatatgtccattattttgattgtgatgatttcacaagtatatacatatgtcaaaacttatgaaattgtagaatttaaatatgtacaatttattgtatgtcaattcattaaagctataaaatataacagatactttaggtcataggtaaaaacgaaaacactgccacagtgaaccaagctatatccagccaaggtcttggtttcaactagggaatgcatgataggagggcatggttgtcctccctggcagcaacttaaaagcatcagatatgcatatataaagctttttagtttcctaacaagagatacttaatagatctcaaattaaacaaacacagccagttatatgccaattctatagttttagaagtcagcaagcagcatattggggattatggatgaactgaacaaaatctagcataaaacatggtaccagacctcaaagggttttgaagactgtcgatgatttggtagagtgatgctaattctcactctcaacacaatccaagcgaggaaatttctccaaaataagataaaaacttgcagggttttaggtgtcattgtatatctgaatttactccacagaaattcttctcccaacttgttaaatttcaagacttctccttggagccatgagcagaataagaaaaacacagatggctcaacttcacggtaataatgattcaaggcaagcaaaccttcagctgtttatatttcagattaaaatagaattgaggagagaaacatcattctgggtgctaaaatgaatattaagataaagctagtgtaagtattattaatattgcactattattattttgggtttgcaatccataggaaatccatgtatgcttctgtttgcttcccttacaactggtattttaaataaattctgcatgctcaataaatagggtctatttactcaaaggcgacagaccccatggtactctccacaaagacttccctcatggcctcctgctgctgttgtttatagggctgcaattacagaaaggattctcagcagaacgagcaatgacaccattaccatcaacaggaattctcctggcactgtggagattctttattgaaagaaatacaaagccagtatgttgctagtagaatgcatgaatttgttgggcaatggctttctccttctggacaccaccctgcaggttaatgactctcaattctgagcatccttcttctctccttccagcaggtgttttcacacctttctaagttaagtgtcccagaatgtaaaggctgccactacagggaggcagcaggacacaatgcatgagactgatcggcagtgaagccggactgcctgtgttcacatcccggctgcaccactcactaacagtgtgacttcaaacagattacttagcttctctgtgccctggtgtgcttattcctaaaaatgaagtaataacagcactgatttcactgggtgaggattagataaggactgagatgcttagaaaaatgcctggcacatacacaataaatgcaagcaattattattattaacacagctttgttgacacaataacatttgtagagaatgaatgacagcagctactctaagctgcctccttatggcaagcacagtaggaacaagaaatagaaatacttcctctaacaatgcagcaaaatcttctgggagagagaaccatacaagaccagcctattaaataacaataattatattaataccacccattactgagtaccttctacacactgcagtgtgtaaaatgcatctatatattatcttattcattcccataaccccatgaattagatgatataacttccattttccagataacaaaactgggactcagagaaattaaataatttccctcagttcacgtggctgagacaaacatttctgaatagaactacctggctcttagccaggtttttccgctatgccatgcaccttttcaacccaaaaggtagtggtgtgttctgagcaaaggcattcaggagaaaacaaacctgtcaggaggcagagtttccaacagcacactgtctttgaaactattaaaagaatagtcttaagtgctgctgggtgaaacaattaaaaggatagtcttaagtactgctgggtgaaacttgtcacacctgaacacagagatagcaatcctcattgctgggtcatctctcagtggcaggataatatacttgaaaggatgatcagttgtttcctggttttttccttggcccctactaggtaccctgattcaaacaaggctgttcattggttagtttctcagagaaggatattgtgtagaaagctcagggaaaaaaaagtgtgtggtatgttggcatcatggcactactggaactggaaggactgtggcactgggatctagtggtgggtgccccgctttctggatggcagggaaaggttctctgatgcttaaatgagtccttttttctgtacatttgggatatttcataattaaaaattaaaaagtaattatctataagcaggagaaaattttatcttataatatcaataaataactcttagaatactctcaagattaattttgagaggaaacttataatcattaacttttatattgagcaacaattctataaaaacacaacagcctaaatcaattcaaaccttaaagtaaaaatgtttgcaacatatatgacctattttgtaaaggggcagaatccacaacaaagaaccctagtaaatcaacaagaaaaaaaaatgtttcaacagataataagtaaaaaacaaaagggaaatttaaaagagaagaaatagatatggtaaattaagatttggaaaagttcaaataaaaacaagatatttttcacacattagcaaacatttaaagaaacaataatagtagttttggtgagaatttgagggctgggctaacaatatgtgtagctagcattcaaaaggtatttatttacatgagaaaattttgccattttttcttcactggtaagaaaaaatgataaacaaccatatatttggaatgatatcaactttttaggattaaacacattcgtttatacatttgtagaaaaagaaattggaaggaaatacatcaagacacatgtagtggttatttctgcatcttcaaatgacaatttttgctcatttatacctttgtgtattcaaatttttataataaaattacattattaaaactttccttggggccgggcaccgtggcccatacctgtaatcccagcactttgggaggccgaggcaggcagatcacttgaggtcaggagtttgagacgagcctggccaacatggtgaaaccccatctctactaaaaatacaaaaattagctgagtgtgggagccggtgcctgtaatcccagctactctggagcctgaggcaggagaatcaattgagccttggagatggaggatgcagtgagctgagactgttccactgcattccagcctgggcgacagaacaagattctgtctcaaaaacaaaacaaacaaacaaaactttccttggtacattctaggttctttaaacaacaacaacaaaaactctttgatggcaaatggaagagacaggattcatgttacacatccctctgtgtccttacagggatgtgctgaggatgtatgaaatttctttgtaataatgtcgttgttttcccaagagcattatttaaggagaatggacaggtctatgggaaaatttaactttgtatagaatgatttttaggtctaaaaagtctagttcagcctgggaacactcttctatgataaaggaatgaaaacaacacaaatcacaatatcatattaaggtgattttcctaaggaaataatgtgtttgacagctgctccccattcagtgtatctgtaagtgaagagagtcaattgaaactaatgttcaccaaagaccacttttagccacccattgttgacttggatgtaaaatggtaagcattgtgtttgaacgattaaaaaatcagaaataaaattactttttgatattagaatctaaatggtccaagaatatgattgtcttggggattctttttgagaaattaattttgacacttcactcactttataaatagaaatttctccttggttgttttcttaacatgtttagaattgatgctaacacactttagtttattcattgcagccaacttttgacaacaagctttcaaattctggagtttaaatatcaaaacttgacgtggtaacattatagaaaaaagctagtggaacacctttaaaaaaatggaatgttgaaaaacaactccaatgaatttagaaatggcagaggaaaattatatgagaagatttagagtcctctaaagcaaatgatttattgaaatattttttcccccagcaagtattaataagtaccttccatatgccaggcattgttttaggaactggagacgcaactttgaacaggacagacttgcttcttactttctggaagcttacctcccagtgaggattgatagacataatcaaaaggtaaagaaagaagttactttcagattgtgctaagtgccatttacagggatgtaggagagttacctggggtgagagaggagggaggaagccgtttgattggttaagatggtctgtctggaaaagaacttttgagttcagttcctaaaaacaaggagctggcctgtggtgggaagatatggaggacgagattataggcagagggaagagagggagcaaaggcctgaaggcaagagcaaacctagcatgtttcagaagtaaaaggaggccagtgtggacagagcctggtgggtaaggggtacagtgacagatatgagattcaacaggggattcccaagggcctcctcatccccactactcaactggataactactgtcttttatgcctattgactttctgcttgaacagtcatttaaaagtgttgaaaggtgaaaaagaaaggtttaaaaatctctgtagttttaattttattctgattgctagaggagatatataaacatacacatgcacacacacacatatataaacatatatacacatatatgcataaacatataaatatgtaaatgcacacatatatacatatgtaaatacatatatatacatatataaacatttatagatacatatgcaaaaacatagacagacatatacataactggtgttttcgaacatttgacaaggattcatactagagaatcagtggcatagaaattgcagtataggaggtaaaattggatattaatgtttggaagtacttcagactgctcaggaaaagttaaccataggtgggtggaagcttttccccagctggagaagctcagtatgtcaatgaaaccggaggttactaataaaaacacatgaatgacatgaacaggtctattctgaaaatagcagagttggaaaatgctaacgttagagacagagtcagtaacaacaatgaagcctgccagattggtgtcacttaagagacatgatctaaatagaaagaaactcaacccattgcatgaggatgcttaagttattttgtttgaagagaaatttatcttgctcagtggaataagccagaagactaaacaggaaaagaccattagggaaagatacccaacgagcaaatcagaacaatatgaaaaaagtaatatcttaaagccacctatattaataaatttggtttgcctgttcagagttctaaaaatgacttgtgaggggagagtacagtgtttctttgtactccattactctttggggtaaaacctgtttgacaactcagttcaacatgactgacagtattaatcatgcacctatatgtggctagcactgcactaggaagtgtctctgctcataaacagtgaaacctactaaagagaaaaggcatgatgttaacaccacctgggatgtggagtgtatccatttcacaaaatcctatcagcagagcaaataatgggaacaaattgactacaggccagggtcaaatcctaaggtaaaagcagtaactgccctcgggtgggtaggagagagcatctctgaaattggccagagctaccagggaaggctattagaatgaagtgggacttgaggctgcccttggaggagctggtaaaattttgataggtggagaggcagaggaaggtgtctctgaatcattaacagctgaacaagagctgttcaatcttatccaactgtgagtctggaaacactgcctaattattaactagcaggtgaaaagaacagaaaaaaaaccactggtgccactgccaggcttccatctggctgtggtatcatcaggaggcccttaaagttatagttcttgggcaataagaaggcagcatcttttactaaattaacaaaattaacttactaaataacaaaagtaattttaattacacccagatttagcagggaaactaaatagcaaacattcaagtaagtgtctctgttgataagcatataactagaaacactcttttggaagtaattttgtgatgtctcaacagtaactaaacgaccatgtcatctgttgacctggcaattgaccttaaagaaatagtccaaatgggaaataagaagtcaaagatactaactgcagagttattgatactattgaaaaactggaaacagctcaaagactaccaacagagtagtcaaagtaatggaagcagatgtgtgatatcattcacccatggagttagtaaaagttaaaattattttaaatagcccctgttggtgtgagtgtaaaatgggtttaaattttatacagggcaattttggaaatatcaaaatttaaaatatgcattcctctgaatcagctccagaaacgctgagaagggatcaacagttaaaatacttaatccacgtagagggctttactgactccaaaacatctccttatttccttttttaaaaatgacattatccacaatacatatgatctttgaaagaaaaggaagaaagaaagatagatattattgatagtcccattttctaatgaggaaactgaaggtcaaagaggtaaaggaatttaactttctctagccctaagttcatatgcctgaaaaatcatgatgcaactggttggaatttcacaaggctaaatacagtcatcttgtttaagtgaaaatatctcttgatttagatatagaaccccatttcatggagccaagacagtagggtctacggaaacaatggctgtcctattcttccctggagatgataacactgcttctactacacttgacagagggggagaaggggagaacaaaaaaaattttttggtcttctgacctagcctgtatgaaagaacaaataacttatgtgcaaatataagatacagtgtgagtgctgaaaacgaggtaaggattatgagaggtctattatctacatgtgttgtatatacttggagaacacgtttgaatgggggaggtgcggcattatttcacagcaggagaaataatcattctcatcatttctaaaagccaagcagccttcagtcagtttcacaataatcaattaattagctaaagtaaatatttagaatgagttacggcacaaagatatgaaatcatggcatataaatgagctttagacatgtaaactgactctttaggaggagaaattactcaagagggagaagtggtattgcaccagatggctgtgtctaataataacttcaatggacacatatgatacttgtttaattatttatcaaggagaatgcctgcaaaaatttagtaagtttataaaatttttggcaagtacaagactgtgtcagccaataatgcattttgagtttaaaatgctccctcttggtggcttatgataatacttaatcctagaccaaggattcaccatttttctgtctcagtttcaccatctgtattaagaactgaaaaacctttacccaaatcagggagtttgggactctttaggactttactttttatattatcccctgaatcaaatacttcttcctacttaaaccatttccaaaagtgtactgtcatatcctaattgtcttaattctgtctcattgccatttcccccttaagttgcctcacaatctatctgcctgacttctagacaaataacttcaaagagttgtctatagaaggtttctagttttctttttcatttctcattattctctttcatttctttctccctgcctcccttccctttttcggttttgtttttgcttttcgaaggagggccaatttaaaaacaaaatgaaaaaagcacatccattactatctgaaggcactggctactacgaatcccttttctttgtgcagcccttttggctttttgcaagacctccctatgtaccatctcacccgtttcttatgatattgttcaacctttaacccactgacctgacttctatccccacagctcccccagaacggcccttgtgaaggtcaccaatgaacccggcccccattgcagtcttttaactttgcccctcagaagaaatcaatcatgccggctactacttggctgaatatgtgacttggatcccgtaacgttgcacacttctctttttcttctaattttctgactactcatttcctctcaaccccctttgctggcttatcaccttcttcctaaactataactgctggaagttttcaaagcctactgctgttccctctattctctttatgccatttccctcatgcccatggtgccagtcatgctgatgaacacagatctctctggatgtgattatcactggcccacccatctcttactccagacccatatatccctgtgtctactcaatatcaccacttaagatatcccacaggagctccaacccgggaagtaccaatctgagtgcatgatttctccctctatttgttcctcctgtgtttctcacttcataaacccatttacccagttgcttaagctagaaacttggcattcatcttgattctctctctctcactcccctgtcatctaatccatcacaaaatcctaaggcttctaccacaaaagcttattccaatttgtccttatctctccaacttcactatcatgccccaagtcaaagccctactcacctgggacctggacatgtgtggcctcttaactgattctcttgcttctattcctaccccacttcccaaatccattctcttttaacattaaattcaatcatagaatccctctgtttcagggaatgaataaataaatcaccttcaatcaattaattttagaattaagatcaaaccctttcccaggacctgcagggcctctaacaaccactttgagctcttcacataaccagttccacctcaaccaccaagctggttgtccaggacttctccaagcgagtcaagctccttctgcctctggggtcctcttctatgctcttccttctccactttccagagctggctccttctcatacctcagaatctcagtttaaatttagtctccacaaagacactgttcgtggttacctgaagattcatggtaagttcccccttatggtctattattgcagcattgtattatttcctttatagtaatcattaccatttctaatgatacgttcatcaatcagtttacttgtttactacctgtctccacaatcagaatatgagctccatgacagcaggaataactttaggtattcacaataaaacatggttaataaatatgggagtgaaggagggatactactaaactatgacattaaaactagtatgaggccgggtgcactggctcacgcctgtaatcccagcactttgggagggcgaggcgggtggatcccctgaggtcaggagttcaagaccagcctggccaatgtggtgaaacactgtctctactaaaaatacaaaaaatataaataaaaaaaattagccaggcgcagtggcaggtgcctgtagtcccagctactcaggaggctgaggcaggagaatcatttgaacccaggaggtggaggttgcagtgagccaagatcacgccattgcactccagcctgggcaacaagagctaaactctggagggggaatgtaatattaattcaaacacccattttttttcttgagaataaaattttagtttcaatattttctatatattttggtttcatgtttacaaacacatttaaaatcattaatatgtttttctttaaaagctactgatttccttatgaatttgtttttttcattcaaagtgtaaaatgaatgactctcattagatgtgttttgaagaaatatctttgctgtgttcttttctctgtgttcagccacgagaaattggtgtgaggctgctggagtgggatgggtccctatcctgacaattataagtcagtataaaaaagtctgaggcaaaagcaggcatagctctgtgggcatttctgatattttacgttagtcattagaaataattcatataaaaaaggaagatgaccaataataagagaaaataatgtgaagcattgtattttttaattgctgcttgaagagagttcattttcagccaaaacacaatagtactttgctcctttggctagaagtacaagtgattccaagaaacttaagtattctcagagctacctgctatgggtatttaggcctaagtcctgataaaaggtaatcacaagcttttaagaaaggtattttttaatttcttcttttcaaattggaaagaaagtgggcaaatggtttgtagtgttctaataaaatagattagataaaaggggcaagaaatcacaggctgaagtttttttattcaatacatatttattgaatatcaatgcataacaagaatggttccaggaggcataagaaacacaaagatgaataaaatatagttcttcccattaagaggctcatcattaggcagaacatacagattagatagatggatggatggatggactaacgacaggtgggtggatggatggatggatggatgggtgaaaggacaaatagatacagcataaagagaggatgaatgattaagcatggtcttctagcacaaagaaagttacaagaattatacatgaaacaaggaataattgagactctatgaatgtaaagaaatgaatgtagttcattaatttgatccatatctcagttgccttactgatatggtttggatgtgtgtcccctccaaatctcatgtcgaaatatgatctccagtgttggaggtggggcctggtgggaggtgtttgggtcatgggagttgatccctcatggatagccccttcctgtggtaatgaatgagttctcactgttattcacaggagagttggttgtttaaaagatcttggcaccacctcctctctctcttgttccctctcttgctatgtgggcatacctactgctttctaccatgattgtaagcttcctgagacctcatcacaagcctagaagatgcaggtgctgtgcttgtatagcctgaagaactgagacaaatgaacatcttttctttataaactgcctagtctcagggattcttttacagcaatacataatgaactaatacacttgtgcaatatcaataggcttttcctttaatatctacaaaattcttacagagaatgaatgaaaaatgaagtctcctcttgaacagcccaaggttaggctgctcctgtatgactagccaatttcattgagtgaaaattcaatggcatcccgaacttggcatgttcttcattaggcaaggaaaggaataagcaagagtgcctggagtatttctctcaaatctatcaaaagcagagaaaccagtcaagacacactgttctgtagaactaaacaagataatctccagacctctgtctccttgtccataatatgaaagtgctgtggcagccaatgatgagcagcagccatggctctgcattactccggggccctgggcctcaaacaagggccacgaggtgaccaagaacacaagcaagccgaggcatagccgctggcacgaacatcccaccaagcacaccaagttcatgggagatgtgatctgagaggtatgtggctttgccccacgcaacatgccatggagctgccacaggtctccaaagacaaacaggccctcaaattcatcaagaaaaggccaaggaggaggaagagagaggagctgagcaacattctggtcatggcttccatgaggaaagtggctgccaagaaggacgaattcctcccctccccacataataaaacctttacaggaaaaaaaaaaaaatgcaagggctggaccagatcagtgttagcagaaagattagcagatagatttcttcacatatgaattggtgttggctccttggagtgctatgttgcaatggaagcacacattctacctcagtagcaagaaggccctctgatggactagcaacatctgccatgagcatgggaatagcgtgacacattcactactgtggggcagatcactaaggtttaacatttaaaccttaatctacctcagtagcaagaaggccctctgatggactagcaacatctgccatgagcatgggaatagcgtgacacattcactactgtggggcagatcactaacatttaaatgaaatgttatctccagggccgggtgcagtggctcacacctataatcctggaactttgggaggccaaggcgggcagaccacttaagctcaggagttcaagaccagcctggcaacatggtggaaccccatctctactaaaaatataaaaattagtcaagtgtggtcgtgtgtgtttgtagtcccagttactcaggagactgaggtaggaggatcacttggatagcttgagcctgggaggtcaagactgcagtgagccgagattgcaccactgcactccagcctgggcaccagagtaagactttgcctccaaacaaaacaaaaccagcgtgagatattattatctaaagtcctttcaaactctcaaatcttatgatttccactaacattgagttggtgtgattatcttcctatatagtggacaacatatcacaataaattcttaattatccatactttcgttatttttgccccaatgttgctttcattctcatgaatgtgatccgaagaaacacagccttatccacaagcatggagcccagcaggaagctgtttaaagcagaatacttcgtttactcattcaaagaagcccatgccacgtaggctgcgatgggctcaggaatagcaagaggtttgccaaggtgatgcaggtgagaaaatacgcatttcttgttctttcctgctcatatttccacaaagtttctttacagaactgtaaattcagaaatcagatagagccatgatgaaaacaattacaaataaaaacaaacgatggccacttatttgagatttcagatagcatgtaccccggttacctcttactgataagaaaatctctacttgtgctgctcttttccaaagattgcttgaactgagaccatctaatcgctagcatctaaattactattcattttcgtgtttatcctctggtactggttactcagcagatgccactgctacgtcaaaagcccggaaactggcaggagaatgtccttccttttcttgctccttgtttcttcaaagtctagcaagatttgagttccttacaatgattctcctgcatcactcacatggctgtatgtgtgactgactcggtaggagctctctgcatccattaaagaccagatatacaaacaaacaacatcatctccaccaaaaagattaccttaatttttttcttttttgagacagttttgctcttgtagcccaggctggagggcagtggcaccatctcggctcactgcaacctccgccttccgggttcaagtgattctcctgtgtcagcctcctgagtagctgggattacagacacgcaccaccatgcctggctaattttttgtatttttagtagagacacggtttcaccatgttggccaggctggtctcgaactcctgacctcaggggatctgcccacctcagcctcccaaagtgctgggattacaggcatgagccaccagtcccggccaagattaccttaaccacaggagatactcttcctgtggttcctgtcaaaagttaccatgttgctttattccttccagatattaaccagatgttagtcattttagcattgtgcatattaatgtcttatgttcttgatttttaagattttccctctaagtcttagaaagtcagagctttaagggagcctgaatacctgcctttgacagctaggcaccacaagggcctcgaaatctgtgcaacttgcccatggccactttgccaccgtgtgatagagcagggtaggagcaataccacctctccagggcccatggccctgtgctttcctcttgccatactgagtggcttttcctgcactttcatgcccttcccagtcttctccggtgggtgaggcctgcggcacactgggctcttctggtgcccctgcagaatctctggcatgcccctctcttggcgaagccccagcaaggatgacatagaaaattcagacaaggatgaaatcatcgttttcctctattatttttctaaattgcctttttcctacccatgactaggcagtatttcctcacagctggggatgaacaaattcaaaaagatgttctcaaatacatggtttccaagagaggccactaagtgttgaaagtataaaatgaacatttttgagtgattgcacagttcatgaaaatgtctctggttagaacctcatcagcagtgattcactctgtgcatagggtccccatggagactggagtcacctcacattagggtattgaggctcatttttcctgctgagatggaataaatggctaggatgcattaactgatggcggtcacaatggtcccatccagtgaagtgaggaatatttctttaaagatgcccttgtggtcagaaagacttactgaactttaagactaccatatttctccttccctttaaagaaaaagagtacttttgccctataggcataaacattcagaagtaaagcctcaaggtcaaaattatatcttctatgatagatagcaagataatgtccctgttaaagaggaaaatatagtttattacagttcaatcatgtttttcttgatgcccaaaacatctttttcaagataataaccaattaaatgagattatatactgtgtgtcttagtctatggggagcttctgtaacaaatactacagactaggtagcttataaacaacagaagcttatgttttggaggctaagaagtccaagaccaaggcacttggaagatgtgccatctggtgaggacccactttctggttcaaagacagcctcttctcatttcgtctttacatggtggaagcagtgagggggctctcttgggtctcatttaaaagggcactgatctcactcatgaaggctctgcctttatgacttaattaccacccaaagtccccatgtcctaatatcatcaccttgggggttaggatttcaacatatgaatttgggggtatgcaaacattcagaccacagcacagtgctggagcatagcagatactcaatacacgagttttaatttgtatatgcaactatgttttaggtactttacagctcagctacttttatttaaaaatttttcagttttaaaactgcatcgtaagtaagaccacagaaatgtagcatcagacaagcttccctacccattccaaggccaaatgaggatttttttgtttgtttctccaccagccaagaacctggggtgcttcagggactcaaactttagttgcagtttccaggcctcatggtttagaaggtctaaaataggcccagaaatctactttccagaggatgctgaaacagatgacctgcagcaaatactctaatgtaattgactcttgaagaacatgtgtttgaattttgaaggtccacttatcaccaattttcttcaataaaagttatactaagtatgcctgcctctcctgcctccccttccatctccttcatttcttccacctctgacacccctgagacagcaagatcaactttgccttttcctcctcctcccagcctacccaacgtgaagacgaggagcatggagacctttatgatgatccacttctgcttgatgaatagtaaatgtattttcccttatcatttcttcttcttttttttttttttgagacagggtctctgtcacccaggctggagtacactagcacgatcatggttcactgtagcctcaatctcccaggctcaagtgattcacctgcctcagcctcctgagtagctgggactacaggtgcatgccaccatgcccccactaattttttttttcagaggtaggttttaccaccatgttggttagactgatttcaaactcctggactcaagcaatccacctgtctcggcctcccaaagtgctgggattgtaggcactgggcccagccccttccttatcatttcttaataacatttatttttcttctagcttactttactgtgagaatatagcatataatacacataaatataaaatatatgttaatcaactgtttacgctattataaggcttttggataacatcaggctactggtagttaagtcttgggggagtcaaaacttatatgtaagttttttactgtgtgggggtgagcagctctaatcctggctttgtccaagggtcagctatagtgtcacagagctatgatttgtgggtgtgcattgggtacatgtgggtgcttccacgtggcttgcagagaatggttgtcacttctcctccaataggagatgtcaggacaaggggatcattttctacaggggccaagtcttctcttttcattcccttaaaatagaaagtcatccaaggtcactcttctccccttccccgtgccttcctaaactgctctccaatgagggtaacacaaactaacacatttgatccctataatatgtaccacacttcaccgattctagaaaaggtaacaattctctgatgatgattattccctccttctttacagacaaactcagagaagttaactaacttgcccaagtttacgcagctaagggaacaagcctggattcaaacctaagacctcaggctctaaagccaccatctgtctcttgcagagacagttcctcaatgttgaaggaaaaattttttctcctgaaagaccacagaaaggatccccacatactgctgtaataggctaacgcccctctgtccttgcactttcccatctttccaaccctctgcttgccatcctcagctctgcccatccagccacccctccactttcttgcctcatcagcccaccccttttttcatggctccactgccactcttgtaggagtgtgtagtccagctctgaaattactctcctgaaaatgctcatgccttctttgtgcccttgtcctttcattctcaccacctgttaaaatccaaccttggataaacccacagagaacttccttctctgtgcctgcctactgggaggacacaacagtgctggagaaaaccacgcagggctctcaaagagtgtccagacattttaccatatttttctggtcagcttcctgtctctcccccagtgaaaccttcaagggttctcccttctcttccaaccttccattcctcatcagcccacttatcctcagcagatgcctgtccttttctgagaaatggaatccattagccaggaactccctccacctgagttaccaaatcagcaatcccacctgctctgcattctggacttcccatgcaggatgtacataggttgactcaagtccatctcatttgtgttaaactttaaaaattccaagtttctgttttctttgagagagtgttacttgctttcagactgcaatgtatatattctctcccatactgatgatcactttttggttattgtcataaacctgagtgcatgaccaccatagtgttattcatagaagtctacttgatgttactaagttgttcctggttcaactttagtacaatatctagatcacaggacccaggttcgaaaatggaaatctgcagcattcaaggacaacaaaaagtgatgtgcataataattacataattgaaatctttaaatttcaatgtaatacaaataaatctctatgattctcccctacccccaccacgaatgatgtctttccacccaaggtatttatttttaaaaacaaaagtgtaaagatagagctggccttaggcaaaaaacgtaggagactttgctttaatcatttgcccccaaatcctaatacagtagaaacactttaggcagatagacctggttatcaattccagcactgtttccttccagctgagtaaccttgggtgagttaactcacatcacctaaactcagttccctcatctataaaatggggttaataatatttagctagcagaggattcaatgatgcaagatattagagtatttggcacatattaggtgccaaataattataggttttattattattctttttagtgttcctagtaaagtcactcatatcatagccccagatctttaacttcttatatccctaggcaatacatacattcactttaaaaagactttgtctgtaaacttctgcttccagccaccagaaagtaacaaggatagaatttattctcctactttaaacaactcaaaaatcaaacaaaatatatgaaatgacggttttcagatactgtacaacaaaaagtacaggatagtgatcattgagagacgggaaataaatgaagtgaaacttatgatagtcccagccactgtctagaaggtttccagggcttaatgcaaggaagagaaaccagaacagagcctgaggtctgtctgaattagacatctggggaaaccaatgcccctggaaatttcagggcagagtacaagagaggaaggagccaatcagagagagagagctttggagatcttcagaggtcccctcagagtctgtggctgcatgttgattaggagagacggagagggaagtgcaaaggctggggcaaaagccacagatggaacctttctgaagctcacaaaggacagggagtagctcaagttctcgagatccagagagaagcaacctcgcaatatgccaggaaagagttcccagaagtgttttgcctcagaaaccggatgaaattatctccagtctaaaggctgcttagatccattaacccaagtataaaatcaaagccttgagagaatcaaactgtttccaaggaacttgactgcatctcaaaacaaacaaacaaacaaacaaaaacttaaaaatattttaaagaagacaaaaaaggaaagaaaaaaaaatccagcacctgacaacataaaattcacaacgtctggcaaccaataataaattagtaggcatgcaaagaaacagaaaaataagacctatcataaagataaaaatcaatcaagacagagattcagaaatgtcacagataatagaatcagtagataagcacactaaaacagctattataaatatactccatctgtgcaagaaggtagatgaaagcataaccatgataaagaaagacagggaagatacatttttaaaaaagaaggaatctgaaaatataatgctcaattatgagaaaaataaatcatggatgtcaaataagggggctggaggtcatagttactcttcatatctaactgattgaagacagaaaatctatagtttagacagtctaaggaccaagtataaaagtgacttttccaggtattatgcattttatgtaattatttatataaatgaaccaaattacatattcattcaactatatagttaccaagcacccagctttaatgatagaggaaatacaaagatgattagctacagttctttcccatagaagaagtccagcacagtctgttagacagatgatagaataattatattagcacataaatgacatgtgcttacaattcaagaatgcagtatgtaacacactgtaaactagaaggcaggctgcagaataataaaaggaaataaaagcaaacagtggatctggagcagaagtcccctacgcaattaatccatagttacaaataaaagactttgacattaacccaatgcaaaaatccaatatacaataattcacatgcatgcacacacatatatacacacacttatatcagtatagaaacactcaaactcattctaatatgggaatttaattgtctggcttttctttctactctctgctgaattagaatgtccactctgagcagaggatgcatttcctagtgtggaatgcaaatattttccctcagcttattgggctgttaaagatactgaagcttctctactccagaggaaatcaagaaaattagggaatgtatgtatttgtgatatatacacatacaaaaattatatattatagattatatatttaatacatgtacatatgtcaatatgcatgcaattatttaaaaatatttctctagttttagtctagtgagtaagaatgtggccaccatagttctaaaggctaatgagtggtacatataccagagtacaacagagcaaataaagattaagctaatcaagaggtgcaaactggaataaaatttaaatatatatgtatttgttgtagtatacataggatgaaaaaatttttatattaataattcagaagaggtcgatctaatgctaagcaagtaaatttatcttattcattccatggaatagaaaagtgactatattatattaagcatttaacaaaagtttgtaacatctctagctaacaaggatataggcttttgtcatttgtggagaacaatctttgatttgctttaagtgatgtcagttaccttatatagtacatgggataggccaaagcaaatcttttttggaaacagattttacacattctcttatctctagaaatactgtagacaggctgggtgcagtggctcacacctgtaatcctaccactttgggaggctgaggcgggcagattgcttgatcaagcccaggagttagagcccagcctgggcaacatggtgtgaattcccatctttcctaaacatacaaaaaattagctggcacacatctgtggtcccagctactcgagaagctgaggtggagaatcacctgagcccgggaagttgaagctgtagtgagctgtgatcaggccattgcactctggcctggatgacagagtaaaatcttgtctcaaaaaaaaaaataaataaataaaaagaaagaaaaagaaacaaaagaaatattgtagacacacacacatcagcttagcactaggatgcaagttgcaggacagcatgtgtagcgtctatggcagtgcctgcacatggcaggtgctccatattccagtcccattggatgtatctaggccatctacctctgccccatctacctctgccatccctttttggacagcagccttctagatacaaacccagcctccctcccctcttgccattcttcaatgcagtctctataaaacaagtcagatgcttttttgttagcagaaataaagaaacaaaacacacgagtcacaggtcacttatctccttaaaacttcagtagtttgcacttcaaataaagtctgtactccaagctttggaaggcatggtctggccccagcctatcctaccagacttgagttaagcaccaacctgccaatcccactccatcccaaccaccacctctggcccacatacacccacttttctcttctttgaagaggataagctcctttcatctcaggtctttgaacaggacattttctgcttttagaactttctcatcttttcaaattctccatttctttctgctcttccttcctgctaactagataagtctaatttatcctttaggtcttagtttgaatattactactttaggggaaccttttctgaagcttctccaatacctccaaacaaagttagcctcccaattcctctttgtaacatcccacaattataattagtcatttgtataattatttgataacatcttctttagagatacgtgttctccataagagcatcactggtcggtcaggccaattgctgttcctctagtgccttgtaaaaaatgctgtaatactgtggtgagtaaataaatataccaatgtaatgtcctaatgtcctggggaagaaagggtaagtaaatgcatagagtgtaacagaactgtcacaagtacatgaaatcaggtacataaattgtgaaacataagtcaagggcctatttgttttctgacacttgatagtgagaaatctttcaacaagatggaaaataaaaacaaaagagaactctgagcatcatcctttagagacccccactggtacccgccaggctgtctgtatccccttcatcatggctgtgtcagagaatgccaccattaatatctgaagggactaaagaaagaaactttgctggtataagtatgattttcattttaaaaacaagcatgtggggtggtttatcaacagacagtcctgagtgtatttgtaagctgaagagacagtttcaggcaggatttccagattctatttttttatctctgaccacttctctcatttcaaatcttggagccctgaaatagtaggaatgtagtgggacacaagagagggatctggagacctggctgcagggtaggctgaaacttgaaggagcatctgagagcttcttcctaatttcacagcagaggtgcgtctgggcgttacggtccccagggcgtcaacaaccatccctatgttgtggccaccaaagccatacctccatcaggccttccttcctgcttgccaggcccataaatctccctgctcaacacaggttttctttcaacaggttcctcaaactcaacatatccaaaaggaaatgagccatcttacccatccttctctttcagccttccccaccttctaagcaaatggctctatggttaaccccacttgcaagtctagaagcctaggagtcactgttgattcttcactctccttatgttccatgtggtcttagtcatccattcctgtggtttctacaatgaaatgtctcatgaatcccttcaggttactccatctgtactgctcaggataatcgctggcattactgccatcactgtctcttatctgggtaactcctgtctggttgccaacctttccacacccccatcagtcctctataggggttacaaacatgctctgtaaaaatataattctgatcctgctactcccctgcttaactttcttcagtgacatcctatagcaccctttatctattagtagcataaccacttatcatgttaatttgtttttgtgtatttactcttttctgtttctcccgccactctaaagcatgacagtaaggtctatgtcctgtattcccagtatttagcataacatctggctcaataaatctcagttaaaagagtgatgcttgaggagatgaaaggatttaacaaatccctcttcatatctgggcatattaaagaggataaaggtgttcctgtgaggattaaacaacccaagaaggaaattagaaaaaagtactctgaggaagcagagaagaatgaaaataagtggaaacaccagtgaatgggagagggtagtgaaggggacggagaaggacttgcaacctatcttggcgttccatgagatagaaagctaagttcttctcagaatggcaggaaacagaagcagtgacagtgaacccagagcttctgaaaaagaaacagcaaggtatgagccaaggaacacttaagggtgctgatagacccttacaagtgtgaagaagtcttttgttggctccaaattagtcactgataaaggatgtggctctatgtagttaattgggaagtatgttgtcttttttttttttttttttgagacagagtctcactctgtcacccaggctggagtgcagtggcgccatctcggctcactgcaagctccgcctcccgggttcacgccattctcctgcctcagcctcccgagtagctgggactacaggtgcccgccaccatgccctgctaatttttttgtatttttagtagagatggggtttcaccgtgttagccaggatagtctcaatctcctgacctcttgatccgcctgcctcagcctcccaaagtgctgggattacaggagtgagccaccgcgcccggccaagtatgatgtctttttggaacatgtgtttaaaatagcacaaatggcatgctaagaagcttggagtaaaagatgtgcatcaccccagagtcaataatggctaaagaaatattgttgacaataggaaaggagatttcaaaaagtttatagaaaagcaaggtattatctcacggccagagaatatccagaaagcactattagttcccatgcaggcctgggcaagaaacttaaaacctgggtactcagctcctgcttttcagctctccttccagttgatgattataactttggaaaagaaattaagttatacaggaagagagcagctggtcacacaagaggtgccaaagcttgggatttgatattctagatttcaacttgtgacaccagaggtggggccttctgaaaagggacaacgtgtgccacagaaaactgagaagaaggtttcaggcaacacctgacccaaattttgaaatttgagattagggagtgacactgttcagcacaaacataaacaaaattgtgaactagatcatgcagaggatatcatatgaggcatagaaggatggatggtagtggagaaggatctccacagtgaatattctagcgtctcacgagaggctcacaggtttgttttttaattaatttttaaattttactttaagttctgggatacagaatgtacaggtttgttacataggtatacatgtgcgatggtggtttgctgtacctatcaacccatcatctaggttttaagccccgcatgcattaggtatttgtcctaatgcaggcattttttaaaggctaaattaagttaggaattgtacgtagtagatcccactctttgagaactacttattgcacattagcatagtaaaggccttgggaaaacctacaaagaaagcaatttatctacgtttaacccagagtttgccaccattgttaggccacctaagtataatacttatgtgacctccactctaccttacaacagtggaacacgaatgttccaacagattggtttaaaaaacctagatctacaccaatgcacaaagtattgacaacaaacacaaatcaaaggcaacaaaaaaacttcacaaaaccaaaacaaagtatggggaataaaacaaacaagaaacaataatggaggtaagtatcatctcacagaacagccaggactttggagtatgggatttaggattggggtataactgtgtaatggtatatttgggataaaaggaacaaattcaatgtaatgatctcaagtagcacttcctgtgaagaaggtaaacagagaagttcataaaggtgggagcagaatcacggtgagaggaacatttggtgatgatgaaaggggagggaagtggaagaggcgtcactgtggaagtgcacgacagcacatctgaaaggtgtgctaccacagtaatgagggatttgatttcctgggaaatccttttgataaaatcagaggatataaaaatcttacgccttgctttactgataattttaatctctcaataaattgaagaagcagtgaggaaagggatttagtgtcagtttaatttcaacaaatatgggaagagtggttggtcatttagaaatatcagaaactttgggagaaagccaagtactcataaaatccagcctctccataatcctgtcagaaatgttttaaagaggatttcttggaaggaaggttacactaaataatctttaagtcccttctgaaacattaaaggctgcctctaacattctgcattcacagttgaagaactccagaggtggccagcatgacacctgagcaagcagtggcatccgtggctctatggctacgtggaaaagaaacatagtgctgcacaccaggtacagtaaaaagggcatcagatatgtcatgtaaacataccatagaaccataagaactgaaacaatgtggtcttggaataaaaatagataaatcagtagtaaagaatagatatttcagaaatagacaaaaatatgcataagaatttaatttccaataaaaggcagaattaagtcactgggggcatggaaaatagggaatataacaacttccagagtgggcaaacctttctgcatttagaaatggaataaagaactcataaatgaaaaattaaatataaaaaccataaaaaagaaccaacattaagaggcaaaacatggagtagataaatatttttaggaaatatgaagtccaaggattaaaatgtttaacaaatgcccaaatataaaccaaaaaaaaaaaaaaaaaattaccaggaaccctatttgataaatggatacagtgtgagaataattatttacaaaagagaaaatgtgaatagaaaatgaaggagaataaggaaataaacaagggtagttatagaataatttaagataaaataataggatgccatttttgcatatcaaattagtaaatattaagtccatatgtatagtttgggaattaattgaccagtacttaacaagaaacttgaaaatgctcatttcttttgatgtactagttccacatgtaggagtctatccaatggaaataattctaacagctaaaaagccccatgcataaaaatgtccactgcaatgttttaaagcaaaatattatttgctttaaaaaaagcagaaaggagaaagaaagaaataagaacaaaggagtaagaagaatatttaatgtatgcttaccatatggaggttatataaattatcccatttaaatctcacagcagttccatgaagtagatatgatcaccattttatagaaaaggtaagatgtttttgcatgctcagggagactaagttctttaaagaaacttggctagtaacagtgaaaaaatggaaacagcctaaatgtaaatagtagaatggttaagtaatctagagatttgatgaattatttttaaatttttaatataaaagaatacaatggaaaaatagtttaggataagatgttaaaaatgcataatagaaaatgttatattcagtatgattgaaatacacagaaaaaagactggaataaaataaataagcactaaccaaacacaacagaacctgaccctgagattgtatcaaggaatgtagtcggctggtggccctgagaacaaagcaaagtgcagttaaattatcaggccgtgtaaatgatgaagggaagcccagaaagaccctgaaaggctcaaaaacagtttaagcaatttggctaacacaggagatagaaaaagtaatttggggcagatacggtaaatcttctataacgcgtagggctgtaattcttttcatggcaagttgctgggaaaatcataaattggtcatggttaaaacgtcagaagactcaaaattacaagaaaaaataatgaattatgaaggttttggcttactctagaagtcgtactacattttctgagagaagtaggaggtgagacgagagtaagtaacttctgctctctgaatatttcaattaggcagctggggaaatgtgggtggaaaaatagaaatctttactttcaagttattagaagaaagtatctgtctatgtaagctttagggaaaaggggcctgggataaacacatgttcaagccatagaaaatgtcatttatgtacacctacctccctagagcagactaatcttcaattgtatgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactactgcataatacctggttgtcacctctccactataaattctgagagggcagaccatacttgtcttgtttactgcgggagcccctgcaccagacagcggctcaatgagtatttgttgaatgaatgaatgagtgagtgaatatacaaatcctactcatctctccagacttagctcaagccccaccttcctgataacatctttcctcaaagccccagtgaccgatctgattattatattaccagtgtgcaccactacttaacacacctgactctacacatcatttttatcattgtttttcaggtgttggtgttttgttttgtttttttcaatttagagagaaaggctcttcaaagacacttatatacatatatatttattctatttctcaaagcactttttacaggacacatgtaaaatcctcagcaaacacctgttaaattcaatggttaaatcttttagatgacttttgactttgtggtatttctaaacattttctctgctgaatgcatgcattgtattaggatttcaccacgtggtggacagaaaacagggaatttagtgtcagctgagctgagtttatagctctgccatttcaatgctggaaaagtcaccgaaactctgctcttctgtttctctatttgtaaaatggaaacattaacaagagcaataacaaaaagaaatatctacctatcataaagggaagacagtgcaatcaaatgggataatgtaggtgaatgagttttgcaaattggaaagcaaatattagccattctatttaccaattttaaaaaacgcaattgatgttgcaagactgtgtatagcaataacagttagtgtggctttttctgagaacaaggctattaggcagaagagaaaggtgatgaggaaaagaatctcaagtacaacttgccaaacatgccccagtcataaataaaagactgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagctgggtcgtgtctatcgctatactccccaaaccatcggctgctgtggggaaaaacaaaccatgatttagagtccataggcaagggtgtttgttttaaagaaaatcacatttctagatatgtgaggcttcatttagcacattcccaaactacaaaaaaaaaataaagaactataatctgcagcaatgttttctctagacataaacacaaagtgtttccaaatactttctgggagaaaacttaatgacatgtagtttatattatacacagcatgctattaaggaggtacccctggaaaaaaatcgaagaattgtttccttctcccagtgaaacaacgttagttaagtcacaaggctgagaggcaaagcagtaatactctcttggtaaaacaagttaattggcttactgtttctaggtgtaattcttgagcaggcaggccttctatctaataagaaaatagttgtcaagcagtagaactggtcctgactgaatttattaagtgttacctcgtaatctattccttcctttacaaacttttacattattacactaagaaaatacaggtgtctacctaacgtgacttttctgaaggatttctaaataaataaatcaaatttaaaaacaggtagcacaaagcttaagaaaacacaaaacaaaacagaagaatgtgtcaaatttgacttagtgctctttcattttcactagttctacagactgatttctttatgggcccaggctcctggttcaatgcatatttttcaaggtggggcaagcttttccactaagaactcaaaaaatccttgtttgtgtcctgtgctggccactggcatttacctgcagccatcatctgaggaagctcctggggaagctgggtgatgttctcaactccacctgcatctaccattgaattatgagtgtccagaggggcaggaacactttgatggctgagtgcagggtcccctcggaggtcatcagattctgcaaaacgggacagaagtgtggtgagaaaccttaatagttaactgagataaaacgtcaaggaacaaactgttatctattcaaaatcaaaaacaaagaccgatttccagtctcaggcacagaagaaatgctgcttcccatcgctcagcggctgtcttgtggctcagttaaaaccttagagccctgtgagatgtgtgggtcaactcatcgactcaccaggagcctgggctggctgaataaacagccccatttgtgagtacctcaaaggccttgcttcctactgaagcaccttcacaaatgggggcttatcagtccctgcacagccttttccacacacactacacatcaatggagagggcagagtcagggctaaagaagatttttttaagttaaaaaattaattgatgctgttactttggaagatggtcgtctgtggaatgtattcagagagggaaaaaagttgggaggaggaaggaaaaaggaagaacccattcaccatgcagctggaaaaggagggtacctaaattacaatagtcaggaaaggcagaagagaagaatggcatgctgtccataaaggaagatctagagggtgttagggaggcaaaggaagagcatttggttttttcagctcattggaaagataatttaactggccacaactttttggtttgaattttccttagaattgcccagcttatatatatatatatttttatatatttatatatatttatatatatatatttatatatagtcttttaatgcacttatctaataaatataacaattaaacattaaagttacaaagttcttctcaatctcacactatttataaaatgctatgccttctctccacccttagaaatgcaaaaacagagctttcacatgtattttaagtgcactttcaccatttcaaaactcagatgagtggcatgacaagtttgatcttaagtagattagatataacaactaagtctaaatatttatttttattttagtataaatttagaagtttttctaaaccatgttcctgttaatgatgattttagaattagatcttatggtttgacagtgtatctaatgtgaagttcgaaccttttatggcatgtctttttgtttctttcattcttaggtataagaatcagtaattccttgagcactgcactgtcaaaaagaacttctgatcagttgagcagaagtttaattcaaatggaagctaagggttcaattctcaacaacaggtgaataatgagcaaatagtttttatggtctcaacaaatccctagccctcaactagaggggtatgtaagatagtgtggaatttttttccaattgtctgtcaggaagatgaatcatcatcatcatccaacagtgaatgattctaactttggaagcaaattgtactgagaataaatattttattccttcccactatactatccaaatgaactcagaacctgcatgtgtattgtgcatcaattatcttaggctatgggtgccatcagacaaagagattctcaccatagaaaataaattcaacagcataagaaatgcatagctaacctaaatgtctggtctattcaccaacgatctttctacgatgaaatctcaaagcacttctctctccacttccaaccatttcagagtagcaaggcagagtcaggctagaatgtgttcattcttttgttcaaatggccctgtagcagagctgtttcagatctttgcaacgtcactatttgtcttacttatctccccaaatgaagtttagtggctagcctccttctacctcagattcttcccaaatgggcattaatcacacatttttttctcgagtctgcagttctggaacactatatcagagaacatccctctactttgtaggctcatgacttgtgcctgacccaccacatttcaccttgactttttgctacactgttttagggatggctttagttttccttggctctgtaacagtctgctccaatggcagttctcactttagtggttacagtcgtataaaggggcatcaagtgtcctggagacccatcgtttctacctaatactttcatggccatcttaacagactgcaagtgtttcattgaaaacagtaagcaactgctactgttccactgaaaaaaagcattgttctgttggcaagatgtggtgtataaacctagatttatcccccaatgaaactcttgtgacattcaatgtattacatctcttcagtctcccaatccaatgtttttttttttttttttttttttttttagtatttattgatcattcttgggtgtttctcggagagggggatgtggcagggtcacaggataatagtggagagaaggtcagcagataaacacatgaacaaaggtctctggttttcctaggcagaggtccctgcggccttccgcagtgtttgtgtccctgggtacttgagattagggagtggtgatgactcttaacgaacatgctgccttcaagcatctgtttaacaaagcacatcttgcaccacccttaatccatttaaccctgagttgacacagcacatgtttcagagagcacagggttgggggtaaggttatagattaacagcatcccaaggcagaagaatttttcttagttcagaacaaaatggagcctcctatgtctaattctttctacacagacatagtaacaatctgatctctctttcttttcctcacatttcccccttttctttttgacaaaaccgccattgtcatcatggcccattctcgatggtcgctatctcttcggagctgttgggtacacctcccagatggggcggccgggcagaagcgctcctcacttcccagacggggtggccgggcagagacgctccccacttcccagacggggcggccgggcagagatgctccccacttcccagacggggcggccgggcagaggcgctcctcagttcccagatggggtggccggacagaagcgctcctcacaccccagacagggcggccaggcagaggcgctccccatctcccagacggggcagccgggcagaggcgctcctcacttcccagatgatgggtggccgggcagaggcgctccccatctcccagacggggcggatgggcagagatgctccccacttcccagacggggtggccaggcagaggcgctcctcagttcccagatggggcagccggacagaagcgctcctcacatcccagacggggcggctgggcagaggcgctcctcacttcccagatgatgggtggccgggcagaggtgctccccatctcccagacggggcggccgggcagagatgctccccacttcccagacggggcggccgggcagaggcgctcctcagttcccagatggggcggccggacagaagcgctcctcacatcccagacggggcggccggacagaagcgctcctcacatcccagacggggcggccgggcagaggcgctcctcacatcccagatggggtggccgggcagaggcgctcctcacttcccagatgatgggtggccgggcagaggcgctcctcacttcccagacagggcggccaggtagcagcgatcctcacttcccagacagggcagccgggcagaggcgctcctcacttcctagacggggtggccaggcagagacgctcctcacatcccagaccgggtggtggcggggcagaggcactcctcacttcccagatggggtggcggccaggcagaggcgctcctcacttcccagacagggcggccgggcagaggggctcctcacatcccagacaatgggcagccaggcagagacgctccccacttcctagatggggtggcggccgggcagaggctgtaatcttagcacttttggaggccaaggcaggccgctgggaggtggaggttgtagcaagccgagatcacgccactgcactccagcctgggcaacattgagcattgagtgagtgagactccgtcttcaatcccagcacctcgggaggccggggcgggcagatcactcgaggtcaagagctggagaccagcccggtcaacagggtgaaaccctgtctccaccaaaaatacaaaaaccagtcaggcgtggtggcgtgcgcctgcaatcccaggcactcggcaggccgaggcaggagaatcaggggagcccgaggcagggaggttgcagcgagctgagatcacagcagtacagtccagcctcagcaacagagggagacgggagacgggagacgggagacgggagacgggagacgggagacgggagagggagagggagagggagagggccaatctaatggttttaatgacatacaacttactgtggctaccatgtgcctgggatggtgattctaaagtaagctctgtcacatcttaggaatttccaatagtctcaaggctgccgtgacattgttcacaaaatttaagttgattcggtcactcattttggaagaaaggtaatacttttaattaattaccaactagtaatttatgaatagttgcaagaatgattttggtactttgttagcatctattgttcctattgaatacctgcctctttaaatgattcaagaccataatgcctaatttatcattcacatcaatttctctgccttagttttattatttctaaactatagaaaagattaatcttcttagcgatgtttatttacacacagagatgtggggagttaaaaattatagctaataaagcactctgaatacagtaggtgataattattactattttatttggaaatgtagtgtttccattaagataccctgggatctttgtgttctggtagataattatgtaattaattctaaaacagtgagtaacacttgatatttctaaaagtaagtgttgccctagttttctgtgccacacctcagttggagcacaatatttcattttccaccattcctttataaaattatatgaggtaggccaggtgcggtgactcacacctgtaatcccagcactttgggaggccgaggcgggtggatcatctgaggtcaggaatttgagaccagcctgaccaaaatggtgaaaccctgtctctactaaaaatacaaaaattagccagcaatggtggcgcatgcctgtagtcccagctactcaggaggctacgacaggagaattgcttgaacccgggaggcagaggttgtagagccgagatcacaccactgcactccagcctagttgccagagtgagactccatctctaaaaaagtaaatacataaaataatataatgtaatttaaggctgggcgcagtggctcaagcctgtaatcccagcactttgggaggtggaggcgggccaatcacctgaggtcaggtgttcgagactggcctggccaacgtggtgaaaccctatctctactaaaaatataaaaattagctgggtgtggtggtgcatgcttgtaatcccagctacttgggaagctgaggcaggagaatcgcttgaacccagaaggcagaggttgcagtgagctgagattgtgccactgcactccagcctgggcaacagcaagactctgtctcaaaaaaataaaaataaataaaaataaataatacgatgtaacttaaaagatgtataaatattttctctctaggttttttctgcctatgcaactacaaaaactttcaagagattcatgaccaattatgaaattggcagtttctacttacagctttaatgaagtatgagcaccacaaaacaatctgatacacaaaatgccaaggataaaagtacagctttgtttggccttaacagatatctaacttgtttcctgttaagatatattcaagtataaaatctcataccaatttcataactgttcaacaaaatatatttatgttcagtatttcattgggctagataatggggcaaatattttttgaaacttatcaagtctatgaaaatactatttggcttaaaaaatggcacaggtttgggaggctgaggtggcaggatcacaagatcaggaatttgagaccagcctggccaatatagtgaaaccccgtctctactaaaaatacaaaacttagctgggtatggtggcgggtgcctgtagtcccagctacacgggaggctgaggcaggagaatcgcttgaacaatttctataggtatcagcgatgcacacatcatgaataataaaacctacctgtaattgtccacaaaacacagattcctgttaaaggagggtagagatcagctaggtattgaaaaatccttcttattgaaaaaaagaaaaaggctgggtgtggtggctcatatctacaaccccagataggagctaatatctataatccactttgggagaccaaggtgggaggattggttgaacccaggagtttgagaccaggctgggcaacatagggcgatttcatctctacaataaccttaaacagttagtcaagcatggtagtgccctcctgtcgtcccagctgctcaggacgctggggtgggaggattgcttgagctggggagtgaggggtgcagaggttccagtgagctgagattgtgccactgcactctagcctgggcaacagattgagtccctgtcttaaaaaaagacaaaacaaaaccaaaaaaaagcatgattttgtttggtctaagtccttaggtttatacctacttcaataacaaaataattgtggtgaaagaatcagatttcttaatgtcttgtaaacagttgataccaggccaggcacggtggctcatgcctgtaatgccagcactttgggaggccgaggtgggtggatcacttgaggccaggatttgagaccaacctggccaacatggtaaaacctcatctctactgaaaatacaagaattagccgggcgtggtgacgtgcacctgtagtcccagctacctgggaggctgaggcaggagaatggcttgaacctgggaggcaaaggttgcagtgagccaagaccaagccactgcactacagcctaggcaacagagtgaaactccatctcaaaaagaaaagagctgataccaaaggaagcttatttcatatggtatcagcaaatttcttattttataagaactctccattagcattatcatggtatatatttacagtaaaaagaaagatacatttccttccaaagttcactctccttttccatcactaaggaaatacctaacttcgatcttcacatagtcagtgccatactctcgaggttatggaaatgttccacggtttaaaacaatatagataattgtgaagtaggtatgcttatgtattaactctttgattctttaagcaattatgaatagtaggggagatacttctgcttcctgtaatgataaactatgtaactgtagatcaatcttcccactgaggaacaactaaaaatcttaatatcttccatcagttttgtaaaattctcactatcatcttttcatatacaaaagcagttcaaaggacattctctgattattgtagtgggttactaatctggcttctaaggagaatgggtcctgttaactactgggtgtttcatcttattgttaagggaggtgagtggaatctgcaagtttaggggcagagtaggaattgctctgtaaagtgtggtaaaagaaaacataaaagctgaatgttctgaggggaaagaaaggagggatctttggtgcccacccatgaagaaaagatgactacagagaagatcaatgacttaagcagaatttcaggtggtttcactgggaagcatacagtgtaaatctctcctcagcccctccccagaaatgtcagctaaatctgttactccttatttcttagataggagtaagttttggggtattggggagcacttagaggagagtttcaagaaaagaatgaaaaggtagctaatgggattatataacatcctacatgataacgcatgataaagactcaaatctgttaaatatagaggatggtgattatttgttaatgatcaatgtcagctgattaatgggaaataataggattaaggttttgaggaatagatttagattaggcatatcatggggaatttctgatgagatgactgtaaagtaggagtattatatcaaataacacttaaaagctctttctcagtgatggagagaaaagccatttcttggaaacagtatgggcagaaaatggagttggacaaagatcaattcagataggggagaaccctatagcacttagtgtcaaacccatgaaatcaaaaggtcttctttagtatctaactagttattcatatacagatgctcctcaatttatgataaggttacattctgataaatccattaagttgaaaaaatagtaagatgaaaatgtatttaatgctggcaatacaacagacagtcctcaaatgacgatggtttaatttacaattttttaactttacgatggtgagaaagcactgtgcattcagtagaaaccataaccccatcacaagttgtaaggagcttcttgacttggagttacatcccaatggagttatgtcccaaaagcataagttgaaccatcctaaatcagggaccatctgtgtttataaaatcactgaactttttcctgaagtgtcacatcacactacattgcacctaaggagagatgccactcctactctttttccagttttctgttaaggcagaaagataaaggagatatatactctttctcccatgctctcatagcactctgtaccttgctctatcccagcactttcactcatattctagttagtttatctctatcatgtctctaataaactataagcttaggatgatcaaggaaactagtcatctgtgcataccctgcagctagcaagcaaagtacctgaaatgtggtaggtgttaaatatatatataatatagttataaatttataaaatatattttacgttttatataaaatataaatattttacatgtaatttcaaatgaattcatgcaaggaggaaagaagagaggaaagtaaaaaatgaagaaaaaaaaggaaaagaaggaaataataaaggaaccaagaaaaaaaaaaatctcagttccagaatttagtcccaaagcttggaagtttaaagctaaagaacacaatgagggtggagggatttttcttgtatactagaatacagatgaattcaaagtgtcaaagaatgacaattaaaaaaaaatctgtcagatctttcaagataagctttagatgcacttaacaagtcaccctctaagctttaagattccacacctccctggcaaccaatgtaggatcacaagcaggttacagtgatgttctccttttgtgagacttcttgcagctgctctttgaatgagctgaaatctataaataactgcatctccagacccattaagcagtacattagtgtaacaaaggcatatatgtacagtactaaagaagtgaaattgttggaagaaaggaaaagtttccatttggcatgcaccacagaggatgaaaagcagacccaaccatttctcaaacatgaaattccattattggtttgtgattacatcctccacttttctactttgtatagcagccaattttaaactacaaatcatcatctttccatcttagagaggacatggtttctaaatgggtaaggttttacccacagcatgtctatctttgaagaactctatattgagagaaagagacagaaagagagatgacctgaaggcccccctctaaaaacatgcaatcaaacaaaatgaccaaatttgccaaggagacaactcaactagcatgtgcaggacagcagagaagaacaattttcttttggcacaaagaaaaatatcactcggcattacaaatataagtgtagagacatgacaagtaaaattatttttctcaggaaaactttgcttttggaaaaaaatatgctttatatatctaaattgaacaaataacaaaaaaaatcttgagaccttatgtataaagtgcccctctttccattaaaaacagaaaagaaaagaaaacaggccttgatgctactatggtaatatgtagggattggtaccatcggaggtttccagaagccactggagatcttgccacatatcctctgtggggaagggaggctactgtatgcagttttaaagtctttgtataggcaggttttaaagtgtaggacctttcacatttagacttctagagattttctgaaaagggcaacattagacttgaagacagtttatgaaatacgtaatggctcaactccttcccctcattcatggatatcaatcaaccacatacacaacctgctgtcatatgttgttgttttctactttccaaaatacacagaccataaaaaaaaaagtgatcaccgctagactttgctggtgagtaaattattcaagaaagcaatattatcagtaaacataagcctggatccattaaagctagaagagtcccattttacgcaaagcttttctaagcccctgggattcagggcaaacacatacaggttcatagagtaattcatcaaggtttgaagaatcaggtaaaacctgagtttatcaattcctacttctcccagataaacatgtctccaaaatgtttctgacaggcaactatccagcctcagctagtgatgggtgtggcagctcactgtgccagatagtcctaagagttcaccgttctctctcctgagcacctatctgaagaacaggagatctaaatctaaattctgtcctcaaaccctacctctgcagtgatatgtggtcttggaaagtgactcttctatccctggaatagggatactgaggcttaactaccatcttacctagccacagataaatttatgaaagtaactaaggacatatcagataattcttgcctccccctggtcaaattttttctgtgtttgcactcttgtgttcttttcacattcacattctaaaagttctaaagagtagacaatgtaaacagaatgttgtaactaaataaaagcctcaattaaaatggcaaagctatggactcctgagacagagcaagagagacaggaaagagtcgtcttgaggaagggataaggcctctgggacaagatttcaggtggatgtcaggcttcaaagatatagccatcaaaagaggtgaattctataaaccatacacatggcaacaaatcaaagcataattttgtatgcatacacagtacagaaaggcaatgttggtcacatcccggcctcttcagctgcactgatacacagaaagcaatttctgtaaacattattgtcttcttacataaaggaaatcagacaatatataattctataatttgtgctgttttgtgctcagctttttcattatgtactcattttacaccttgacccaaccgtggaaaacatattaagctagaaagtggaacattttaattgtagtggataaataactgacccttaaatggtggcaaactggcaaattagttatctattttccaaaaagccctggttagagccctttaatttatggaaatctacctgcaataaaacccagatcagaccaagaccagcctgagccagttgctcatcctgtttaacatttctcccagtagggtgacaaataacatattagttactctttaaacaaatgtgctcttaatgatgccactgccgcatgatgaataaagcattagccctgcagtcatgatcgccctgggacagggagcgttagcagaacacacccaccttgcatggattgccctgggtgagagactttgctttatctttctctaaatgaccacccatagcccttgctcatgctctgtaaccagtgagcaagaacagtggagccttgggtcccctgtgatggtcctttttgcttctcagggcctcataaatggtatggctatatcactgggagtaacccagaaggcatgatggggtagttaggggagggctatgggggcacaggagcctgatgcaaatgactgcacagcagcacatccagttggaaagttccagttcagcagtgagcattctgaggaaatgggtcaaacctttagtgctgctggttatatccagcaagatttaaatgaaggtgctcagaagagaaaaaggcctgagtgtccaaaaggtattcaggctcctgaggctagaggcagattagggggcacagaaaggtggttccaacctccaggaacatacatgattcagaagctgaatcctggttatttcttggtaaaaggtctttatgttctagctgcttttggaggtcaggcatcatcaaaagcaggaattggctacacctggttatctcagcaggccctcataacccagaaaacctccatggaggctcccacccccatcaaaagagatgagagaataaatgctgatggaaaggctccagctctgaaggcaaagttgaagggcactacaaaacactgttgctacagacccaaggcctttaccctctgtctgtcttggtcacagatttgcattaaaatgtcctccacccctaccgtcccccattaacacattctccttttcaataggaggagatatttgcctcttaagaatgccacataaaaatccttccttacaaggagatggcatttggaggactatgttcctcaaatagtctctttttctactacagtcttacagaccaaaggacccatctgcctctgagcaactagtctatttttttaactagggctgtgttctcaactaggcactagaggcataaggtctacaataatgatgaagacctgaaaatattttgtgtcaacatgcaatgaaaagcacactatctaaaacaaatatttaactaaatgtttataaattccatattatgacaattctaattatcaaatttagtattcacatgaaagtcattatagttgaaaaccatttgtaactgggctatctcactttgcagaaattactgagtgtgcaccattatggagaaattagagctggttttaaatgaaagaaataacttgcaggcaaataatttcaaaagcaaaatgatttaaaaaatcatctccaaagttcctataaacaaacttatactaaacatcagatgtgaacacacttgttatgtttgatctgatatggagtaagtaaatctgctgctgcctagaaaggttttaaatggttgtgttctgaggcactgtctccttcctgcctactgtgtgtaagataaagctatacttcctctcaaatttgccaaactcagttcaggatcgaatgccattccgttatttattcatggattacataaataattgtggaaaagaagaaggaggcatgagcaaaaattgaccttaaagaatacagatgagagagaaaaatatctggctcatggtaccgaatgcaatttcatgttagcttagagtcatcgtatgtatttaggttttattatttataaaaaagaaatcgtgctgaatgttctttgtgggaactgcaatatattgctattgctacgatggtttactattttcacagctagatggcttaaacccaaactaaacaaatattttaaaagaattcccaccagcattattacttttttttcgtttctagtgttaatgaaaaagatcttctgcttttcaagtcctctgatatctttactcttgagcaattctcaattttatggcttatgatgagataatgtttattgaaaaataacaacttaagaaaataaccagcaactagtggtggttaagcagtgcagtgtctgaagtgagggcatttgagaactgcagtggctgtcaactccaaatattcaccaggtcttgactattacggcaattaggatgatgattttattacttgcacactgaagtagacatatttttgtgtactcatccaagatatcaacttgacagtgtctactacacacagaattttgctaataagataaaaataaggtagatgtgacagtgagacacataatcaacataaaacaaaatgcaccatcatgtccagacttctcactgtatgaccaaacccttactttaataggggtcaccaccttcattcaaatgcactccccaaactcttgctatcattcttaactactggctaattcaccatccttttctctagggataaaatttgcacagaaatgcaatgacacagttctcttcaatctgagagtaaatatcaatatacactagagaggtggggatttttttgttttaaaaatattattgctgatacatgtaatgagttcaaacaaagctaaagtctataaagtaaaaggggaatgccattccgttactccttatctgccagccaacacactccccagatggaaccgctgggaaaatagctccctatacagcagtcactgtggcaagaaactcacatcctcgatctcatgaaaaagactcacaacaacctatgagatagatgttattccaactttttacaaaagaaaataaactaaggtccagaaggctattcctttggatttttacccaaggtcagaaagccaatgaatggcagagcccaggactcaatgtaccctagcctggatgtctgttgttacagatttggggaactccaactttctcccacaaagagtcagactagaaggttcctctgggtttaactggctctaaagagagaaagaagtctagggtaaaggttagttccatccctgggggtagatttatttatgcaacatatctttataagatgttgactgtatgtagcactgtgcttgataccaagaacgtaatagtgaacaagacatagaccctgtcttcaaaaagtttgcaataatacagtcaggtaactaaacaaactaaaaagtaccagcagacatgaacttgctatagcatggcaaattagatattcttaggaacatgcctcttataagaaaacaacaactagattctggataagaccacttatttatgtattactaggctttctactaggcttggtaaaggaaaccctgctagacatctgcttctaaaaagaaagaaaacaaaaaaagttggctgaaaccagaaggatgagccaggagtagtaagttgcttggagggaaagtgccaacatcagcaatgcaccaggagatagcctgtcatggcaaggtcaagccctggtctgaggtttccatggcaatcaggacctgaagatttgttgcacctttacatggcccttaccccagtcagccttctcaaactctcgacttcagttttagaagtaggcaagtgaaagaatctgggcaaaccagcagaaatcactgctgaaagacaactcaagacccatgctttattgagaggcacatttttcttaaataagtcagaataataattgtgtacttagagaaagagagagagagaacaaacatataaagtttctacctagggttgatctgtaatccaaattgggcttaactcagtccaaatatatatattgagggcaaactgatggtttaagctgagagcttgggataaagaaggtataaacatcatcattatcaaggactgtccaggtccattctccccatgtcaacagcttctatttgcaatctctaaatcatccacaccctcaccacaactgtactgcctgatagaatgcactagtgagtgaggcggatggcaaagtagaaaggctggtcccagctttatatatagaaaggctgggaggtggagtcaggttactattactttttcttacctcatcccctttctgccagaaccttcttctgttctacttctcttacttgtaccaaatacactctctctaacacgagctatctcatcatgttggcagctagctacaaggaagaggcctggaatgcagttctcctttctacctgtcattgggaataggagctacagaaactagggttggtgaggcgggtggggggtactgtggaggtgggtaaagccacaagctggataaaccagaaaacccaacttctaactcctattccaagggatagctgacattctagaggtgctgaaagagtgaggatctatgtcagttatcatgtgggacactgaaatcaaagtccctctgcatgctgattagaatcatcacccattgtggcggctattttttcattctcagtagagacaaactgaaaccctgagaactgatctgggcaagtcgctttctctgactctcctaagaaacgtgcacagcagtttggcagcacaatttgcataccagaggagagctcctgtcacaagtaccctgtgggccagtttcctgagcttttccacttgatgctttcaagcctcatctcacgagtcattggagaggctaacgtataatgccttttggaggagctgaaaggaataaaacattactagcaaaacggtcatatattttgagagttaaaatctagatccctttagataggccctctgaaagaaatgctttcgactacgatggcagcagcaaaaactctgttaaggacagcttcatgagcacaacttcccagccactattcccacctgaaaagtacatattctggtctgcatttttttttctacaagtattttgctttgattcattgttgatacacatgacagcagaataataaactaggtagtttgagcctgtgtgtgactgggattcggcataagcatcacaattttggtttgtaaattcctttggttcagtagatcaaatggggaaagacttgtgtaatgtgaaattcaatgaccagcaatggcagggatcttttggatatgtaatctgctgttggagccatgcttggggaccaaatagatgagcaggccatgttaggaagggcagcaaggaaaagagaaaacatgaattaatattaaaaatgtgatgcaaaataaaatggaggttatagtcatatccttccaattgtattgagctgaaattgtttctggatttggaagctccttgctaagctaaattgcaaaaataagattatatgaggagaaaaggtaatttccaaaatataataaacataatacaattactgcacacttatatatgaaatccagaaaggtatatttctttcacgccatgtgatcacagttttgttacagttttatgttcttattttatgctttccactagttttcttgactttgcatattcttgatgcaaatcagtgaatgcatataaagtgtaaacaataggctctcaacatggagcctacccaaatgatttaactgtgtagcattgattatcttgtccactgtgtgagcaacgtgcacaaaatatgcattttgtatgttacggaggtcttgctgatgtggatgaagaagtgtgagaactaggatggagaagaagctaacttcaacagtctactctttagtgtcctccctttacataaaacaaaacaaacaactgatcagctactagtaatcaacaaacttaaatttgctgagaggaagtagttaaatagcaataccaagatgtagaggttagggaaggttgttttgcccctgcctattgacctacatatactgaagcaaaattggaaaactgcagcatatttggtcacaaggtctttctatttccattcataatttcttttctttattccctctttttttttgttcttcagagaacacctttcttgatatgggtgttttaaaattctgatcagaactggcagtgggaaaagagctgaggaaataacggagactcatacttatgtgacacattcacaaaccctatgaatttttaatgaaggcacaatgtccacaattagatttgaaatgaggttttctttgtaggcgctcttacagtaagtggagtgcaagcgaattttactttatattcagtaaatgataccaagtgcaaaaaacactacaatttaatagaaaataaaaacaaattgttgattgttcatagctcctttttcatctcttagatttacaaaagtgtagcagttaaaaaaattgcatttcgttttatttaaataccacatggatgccaaggcaactcaaaggtatagaaagtcattttcagtcatgacctgaagctgtccttttgcattgtgtggagaagtttttgtttgttttaaactgtaaaaatgacttctaaatgtagatctttggggagaaagatattaagcttccctatttgcaaactaagccatttcaaatgaacataaaaaaaaaatctaatagtgtagaaaataaggaaatagagtgggctgatggctacttcgtttgcattttgattttaaagcttaactcttgtcttcatagggcttaggttttcagcttcgcagaaacagacacagtttcccatccttcttaggtggtttccaaagtccttcagtttctggctcctggtcaccttggcaacatcatttcctaaagctgcttcttctcttggagctcccgcaacacagatgcttttactcttccttgagcctagcaagtgtgatcttctcttagtgactctgcacttgtggttcctccaggtaactgcgcaaccaccctgctccctcacctgggcccttctctgacgaaatgtcatccctgacctctacctaaaatagcaactgcgtcaccttctgtccttctactagccttattttctttctctctaggatttcttggcatctgaggttatattacatagttatttctttgataaattagtcatccatgagggcacacttatttttaaccttttaaaaatgtttttcttggtaaattgccatcagccaaaacagtgcctagtacttagtagacacacacccttccctcccacatacgcaaattcattgattaaatattatgagtgggtgtatatatacatacacacataaatatgtataaacacaccgtattaatcattactgtttgattttctatattcctgatgctttgacatatgggtccttgctgacattggagggatctcccctcccagggctagccaatccaagagagcaaacgcctcacctgggagcacacacgtcataggcaaaccaaccaatccagatcccagaccctcgaacacctcctttactggctctcagatgctgaaccactattcctctggcctaatcaccccggagccaagtataggccttataccccagagcttaaattattcaaactagcccatcctacgcctgtttattccaccttgccttgcctcctgttttgcagaaatcacaataaaggcgctctcacttcctctcccttctgactgaccctggcgcctccctgtgtggctcctcgttgtgtggtgtggcaagcttccttctctttggaactgtgaataacaaactatcttttctatggcagtcgtctcctgatctgttggccttaccacaccctataataataaaaactgcattttcaaatgcaaacaaataaacactcaaataaaattcactgtattttcaaggacaatgaaatatagtaatcgccagaagttatgatttttctggactcataagaaataaaatcaggcagggtacagtggctaacacctgtaatcccagcactttgggaggccgaggcaggtggatcaatttgacgccagttcgagaccagcctggccaacatggtgaaaccccatctctactaaaaatagaaaaaaaaatgaggtgggcgtggtggcgcatgtttgtaatcccagctccttgggaggctgaggcacgagaattgcttgagcctgggaggcagaggttgcagtgagctgagattgtaccactgcactccagcctgggcaacagagtgagactctgtctcaaaaaatgaataaatacataaataaaaatagaaagaaagaaaatgactttgacattttaaagatctgtgtacagtttcaactccgtctcagccctgagattcatttatgaattgcttttgtggttattattgttgctttctactttcgccctttaagtttttttgtttatttatttcttttttttaagggggattcagacactattacctcaaaggagcagcgctgccttattctttttgctagatacaaatcgttaaccctattcaccaaacagcaattaattgtcaataaaacacatccacactgtgaactctggtgtcaacgtaggcttatcaattgtaacaactctgagggggatgttgatatgggggagaccatgcatgtctgaggtctggggctatctcttagtctgtttagggttgctataacagaatacccgaggccaagtactttataaagatttagctcatggttctgcaggctgtacaaaaggcatggtgccaacatctgcttggcttctggtgaggccgtttcatgctgcatcatagcatggcagagaaaatcaagggggaagtgaacatgtgtgaagaggcaaaacctcaggggcatcctttttataataacccactctcatgagaacattcctcagtgaactaatccagtcttccttgagcgagaactcactcgctacttcaagaacaacaccaagccattcatgagggatctaatcccatgacccaaacacctcctattagacccacctcccaacactgtcacactggggatcaagtttcaacatgagtgttggtggggacaaactcaaaccatagcagatatatgggaaatttctgtaccttctgctcaaaattgctgtgaatctaatagtgctctaaaagaattgtcttaaaaaaatacatacacatatatgtttattctctttaaatataagaaaataataaatcctatccataatttcctaaattatagttagctctaaatgtaataagaacacatttctatgacgtgatgcactctgagttttttcaacacatttgttccttttttattccaaaaactatggttcatgttgttccatggccaatttgccagatgcttcaacattccctgctggaacgcacctcagacagggctaagtcagggccttccaggggcatggcaaccatgaaaactgatcctgggaaactgacctttaatatattttcatagtaagctcagaggaatgtgctgggtgattacccattacttgtacctggtaaggacacaggcctgaagctagagtctttgcacagtagagatgggccagcaagatataaagatgtccacagaagtggccaaggaaaccactagaatgcactggagggagcctcaatccagtcagttgctaacactggcagtagggccttccctgggatttgatagcctatgcagctgtcttcatgcagttcagattcatgcctcctttacttaccttacagagctcttgccaacatggtcaccctggtgacaaccatgtgctctctaacagaaatacctgaccctgctcaaggtattagaaacaataagagaataatttttaggagacttgagagaggtcttaaaactgtgctcatatgctttttttgaaaacatggttttcaaataaaagcaagggttgagacatccaaggagctagtcgctctccctctagtccttcggccttcctttctgcctggtgttgcacattgcctcccacacgccagtgctcacagctgctccactgtgggtgtggctgttccttctcttctctatgcttctctctttttaggctcatataaaggcccacctcctccaagacaccatgtaagatcaattttctacaaccacttgctcctctgaaccccagagttccccaagggtggtatgtcagaggatttaatgtgggacccaacaccattattttaatttttaatagctatatttgctttgagtcatgtgaaattgatgtttctgtggatttaaaaaatggtcaaatattggcagtttcatgtagttcaacctaatatgtgtcagggaaaaaatattaaaagaaaaccagacatcattgtttaggatgaggctaaaatgagtactttattgaactgtgtaaaaatgaataagtaaataaacgttttgatggtacagatacagcaaaaattattaagcttgtatccactactgaaccactgaccaaatgtattttgacaatcactgttctacgtgtccttttaacgtgtcttattattgtgtgtgtgtggtttttttttttttttttttttttttgtatatctatgtatttgtgttttctcttccattagtttcctggatatttgtacacaagaggcaaggagagattacaaacctcttagcataatacccggcacgcagaagacggacttgacatagggatttgtctggtcacttatgatgagatcttaccaggaaacaccatttgttttccttatggtcattctaaaactggaaactgatgggccacgcaatggagtatgccattccagccaggaaacctacaacctggagcaaatgaaaacacaggactcctatggagcactccacgctgggagctaacctcaccactgggaagcattaaggggtagtgtggcctgttggtcagaacatgaccatctggactcattctcagcagtgtgattgtacattacatcctccacttctccattccaactgacaatgccaccaatagctgagaaagtggaggccatgggaagctggtacctactaggatatcctattggctcctgtcctctctgcccagttactgaccacggcaccaagcttcagattctgtttaatactgtcctttacacaatggtgcctgggtcttttgaaatggatagggataattatgattcatatgcttcaagaaataaaccacggtactcacacaacctacatatttcatttctattttaaaaacacaaaatacttacatgctgttggtgttttgaaagcttttgccacttatgcttttttaaatataatggttcagaaacaaaattctgcctgctaatcagtctttatttccattcataaaaaattatgtctccataatacctaagaggtcaataactagatgttgaaacaaataatattaaagaaaaatatttattgtagaagtctgtggttgaggcagaagaaaggtgttattttcatctggggtatcaagaaaacaccatgaatggagaagaatatggtctgagtctcaaaggattaaaaaaaaaaaaaaaccaacctatgtgggaagagagacagagagaaagtgcgcaggcagctcaggcaggaaatggtaaactcaaatgtgtgaaatcgggagcgttggaggctgctgaaaggacatagctgcctctttactattttacatttaagtcaagttattcagattatattggtctctgtatgtatataatgacaatagtagttttattctctaaaaagttgctttgagaaaaatgtcaagggatttaaatgcatgcttccaaagtacaatgttttcctacataaagatgctggtttatcaactagaaaactaaagtgggcttctttataaaagatagactgaaaagattaggaaagtcttgacaatataaacatacatttactcaccaactcatgaaatactaaaactaggttttactgctcaaagaaagcataaaatagatcatttcagtagaaagaaaataaagcacattttttacaacatagaaagtaatctcagaattcattaaccaagagaccaaaaacaatacctaaaatattatatatgttaagggagctttaaataaagtcatggagagcagatttacaatgctttaattgaaccaggataggaatggcaggagtctgttcacaacctttcatggcagagaagagttatataacagccttgatattggccagctgcaaaaaaagtcaataacaatatgaagatgacaggacttttggaagaaagttactatacagcttggagttcataatattatgtgaggatagagaacattaattctaatcagatccacatcattatttacagaaaacttttttttttaaggttcagagaaaatacaagtgtgatataaacacacaggtatcagggctaataagtgtaagagagatttagaaaaataaaattttgattctataactggatagtcataatcctagtgaaacaaaaagagatgccactgtagaaatcactatggcttacaataatttctctgatgaattttgattctaaaatgacaagtaataaatggaaccaaggacacgagggtaaagacaaacaccagtgtgtgggaataattcctagaagaatgctgaagaggcctaaatacaggactgggatcgaacattttgaaaaaacataccaaagggatgtttatagaacatattttttaaagtcttcaaaagaagaacaaggaaaaatagcaatacttttggggaaggccattaacaataaatagcaaagatgacagaactgttcaactcccattttgtgaatccacccctgcaagcaaaataatccgcacattgggaagggtagaataaacaaaatacgcatggaatttcagcctgacgtggtgatggggggatttactcaccaacccagagctagcatcagacattcacagaacaagccagtaagacccaatcctgcaaccaacataatatgacactaggttaaatgcttccactttcctttcccgaaaatctgagcttgtggcaactttatcgggattcaatcatttgaccttgagaacttagtgcaactatggaaatgacccataatgactaccggaattccaaagagttggtgccagttttagaatgacaacttactaggtttgtgacctggggcaaaagatacaggatgagactgattttcacatattagaagtaaagcggatatagaaggtgaactagattagttaagcaatacgccaaagaatggacttagtgccaatggttagggtttatggcggaccgatttcagggtcatccattctttttcccattcattcagtgaatatttagtaacttccactgtgtgcagcaccattttaaattctaggtgaacaagaaactcactccaaagaagggagacctggaaaaataggtcagtataaagcagataaatgggtaaatgcattaaaacgcaggttaacagaaacaacacagaagaaaaaacaattaactttgaaggtaattttagattttctccaaggttaaatagaggaaaaaattggtggggagggataataaaacaccttaaaatgtgtttcaggcatgacaacactatgatcaaaaatacttctgtgtgaaaagtatgtggcatgatacagaaaatgagtatttttgtttggctgtagtttaaagggaacatggtgaaaaagtggagaacgatgctaacaatgtaggcaggggtcatgctaaggagtttaattcctacaggcaatggagaccaaatggaatattttaaatggggagtgacagggtcaaatttgtaatttagagcaataattcttagagaagtacagagtaagctctacaggaagacaagcctgaggagggtaaatctatttggaggtaattatgggagaccagacaagatgaggcagtggcagcggagatgaagagagggaacagatttaagaggtacttctggagacagaagagatagcaattggaatgtggaagtgagagggagtgagtgacatgtgtgagggcccaagaaggtaacattcaaaaatgaatcccaggtttccacctcaaaggaattgttggataaaaatagggatttccatggcacaagaacacttaaaggattagtttagttcaggaggaaaatgtaagttttccacagagcaatcaaatgcttcaatattaaacttacaaaccatacaaaaatgtatctgtcccctggatggctatttgcttccctcagtagccacaaagctatgttgtatgcctggcacacagtggctctcaacctctgatgggcattggacttgaatcaaattgcctgaggagacttttccaaatgcatatgcttggtcttcacccccaggagattctgatttagtggatctgatgtgaggtgcaggcattttttaaaacagctccaaaggagattctgatatgcatccaaatctgacagccactgtagtatacagtcgatccatagctctttgagtgattagttaaaaggaggaagggaaggagagggcttcttgaaatttttgaagaagcagctggttgactttctatgctcaacagtgtattattgtgtgagaaatttactaaatgaactttcctgtcttttaatctttttttttttttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgagatcttggctcactgcaacctctgcctcccaggttcaagtgattctctgacctcagccaccacgcctggctaatttttgtatttttaatagagacagggtttcaccatgctcgtcaggctggtctcgagctcctgacctcgtgatctgcccacctcagcctcgcaaagtgctgggattacaggcgtgagccaccgtccctggccttcctatcttctaatcttaagggtccacaaatgtgatgttatagtgttcctggcttcaacttgcagacagaacactggctgagagattactggactcactcaaattcaatcttttcttatatttttttacattattgatgaacatcccttcttatagcaactcgttctttaacattttttgtgtgcttttacatatttttcatttacttttttctcaatgtctattcctcctactagactgatgttctatgaaagcaagcattctgtttcttttgttcactatcgtgtatgtaagcactgacctagcaaaacacacacgttcagtcaataaatgagcaacgagccagatttttctggtgaaacatttgaagccacaatgcattattttcaatatgcctataggtacatccatgagtgtattatagattcagaaaatggtttcagaaataatcaaaagcatacagctataggcaaaacatgtttatatatatgtatattttttacctcgaggaaacctttgactcccaaaatttttatgttatgtaagacagccccttacatcagcaaataaaattaaaaatagggaataaatatctaaaagggtgaattaggcacagaggtgtagcctgagaaatagaagctaaacctcgttcctgttccttatctattaatagatctcagaagcctgaaccttgaagtctgataaatctagagctttcctgtcatttatatctaatgatcaattctaacagttagacaaaaaaccactaaatgaatgaaaagatgaattattgagaaacttagagggtcttttagcatggcaattaaagaagtagaaacaagtggctaacttgaagagccagaaatgttaaaaatctctgtattaatagtgattactgaagtgtttttaggttccaagttaaacatttgctgacactgcttactacaatatgtaggtaactcacgacatttttaaagacattttactgccctgagattgaatgtgagtttttttaacaaaaaaattatcaaaatcagaattctactttacctaaaatttgccaagcaactactatctgctactactttcgcatgtatcatctcatgtagtttccataaaaactgtactttaccaatcagaaaactaaaaataagagcaaccttagatgaatgcctaaaactagaatgctataaaaagtgttaattataatacaaatcactgaagtatcattttatccaggtaaatttatacatatgtataaaagtgtatttttaaaaatactaaatatgaacctcaatcataagaatgatacaagaatactatgttttgattaatgataaatttggctaactggagaaaacattgtttcaactgatgttatcaaacaggttttgaaagcagtaataagacacattgacatgatatgcttgatacacttgagaaggttacaccacctctgtggtattcttgccaaaattttataacctcaatttaatcatgaaagaacatcacacaaacccaaatcaaggatattctataagataaccagtacgcttcaaaaatttcacagccatgaaagacaaaaaaagactgaagatctgtcctactgatttctgatatttctaatgtaagatcagtagtcattacatactattggttgtataaatataggcctaagaaattggaatgattccatgttgcatccagcgtattaactaagtgttatgatgcaaagttgtttgtatattagctgcaatttcccccatgacttataagaaaaaaaattccttattaactaatgactccagttaactgattgaaattacattctactaagctaaatatacatgtcatttcttacaagggctgtatgtttttataaatcagtatctcagctcgaattgttggaattatcatggttacttccattgttcagacaggaaaaaagacaggagtagtaaaacaaagggagaggggccatttgcagcaaggagaaaggaaacacgattctaaaacacattcattaacccagggctactactagatgctctaggctagaaatgaccaggctgcttctaaacagattttaatttttaattcagtagaataggtcagatacagctctcccacctggaggtcctgccctagaacctacctgcccgaaggcggcactgcgggtctgctggtaatcatcatctttgggcaaatgaaatctccagtcagctacacccgctctgtatgttgtgatcccaagaaccagtaataaaagttggacaagatctcacaatgaagtggaggttttctccttcgattttttttttttaggagcaagaaagaacacttttttttttaagccattagaaatgtttttaaaggtagaggtagaaggagggatgttggtgtttgaaataaaattctaataaataaagatcagttttactacttaattaaaattgggtagaggcatatatgtgggtccaaatttgatgctcaccatacaaatgcccagacacgagagagatctcctgggaaattaaaacgcctacacgtagggagaattgaacagaccagggccccagagcctccgcacatggagctaaaacaagcatagaggagccgagtcggactgattccccagctcttcacagcccccagattagctgggtattagtgcaggctggtctcagctgcccatgaaaatgagaacacattttaaaacctgcatttgaattttaaaggtactcaacatttctagtattgtttactgaaaaaggtcaacactcaagtgttttatttatgcacggcagaacctcagtctaaaagcactaggctttccatatggcatagcctgagaatgtgttaaatatgtagttccagagccaagaatattatttttcaacttagcgaatgcattattaaaagacctctgctgtgcccaccactgggagatagggcaagaggcagcagtgaccctgcattctgaatgcacagagacactgacagtcactcactctaaataccaatgacaatatccccaaacccacaccaccctaacccatgccttgctctgaatttgggcagtctggaaaaaatgaaaatggaaacctttaaataaaactcataaaacttcagttccaagcacaatatttttggttctttggacaataagtgtttcactgagatttatgcctagggtccttttccatatcccggctctgtgtcagcgttcacatcagccctcagttcttcttgcaaatcaagggtataatatactgattccttcaaataatatttgtgttaaaatcattaaatgcccatgcaagtaattttttattaatgggatgagaaataatacataatacataccaattttatgacagcgagaggagttattaactttagaatatctgttgtataaattaaaaatcttaagaataagtccagtgttttaaatatactatggaaaaacaaaattaatgccaggagaattttgactggaatatagaaatgcctttatcattctgggaaaaatactaccctataaaagccacatcctctgataagttcagaaattatcctttttatataaatattattcacttggaaaaatgttttctataaacagctcccttagtgcattttaacacatacttttatttacagacattagatttacacatgtttccagtataaatctttcgtatatagcaaagagaatctgtgaccaaaaattctgttcaattcggatgtggggagcaaataaatgaccaatgttcccatatacatagtaatatatggctaattttatataacatgttcacattaaaaataagaacataaaaatttttaaatcttcaggaactgtcttcaggaaatttcagaagactatgacttttaaattacgcttttacttgatccaccttccaaaagctcagaatccttatattaaaagagctggcactgacataatttgatttaatcctgtaaatatgcatggaagtcccgatgtacatcatctactatgctctgcctgcgtgatgcaaggtgaatcaggcaccatccactgtccctcttgttaaggagtccacaactgtgctggcaggacagacacgtatataactgattataatgtacttgagataactggtatatcccggtggtgggaataagaggctttggcagcacacggagtaaagagcgaggatcctggaaggcaacctgcatgtagggagagtggaagctcacccgaggaggtgacatttgagctggttgtaaaggaagaataggatcagaccaggcgaaggagaggcattccaagtgaagaaaaaacaattatccacacatgccaagtttttcagattt

SEQ ID NO: 798 - DNA, 12721 bp, Homo sapiens
ccagagaagtaggagtgttttccaatttataaaatgcttttaagttggcctgagacttgaaacaaacaaacaaacaacagattctggtgctgcaaactctgctagcgcagaactaagaaaacgtccctagagacgggccccgaaaggacgcctctgagtgccgcagcccccactcccatgccctcccggcccctccttcactgcgcggcccctcggctccctgtgttttgctcacagaagctcctttttcatcggtggaaaggggccacaacgtcggtgtccccttccagcacgagcgcgggtcagcctcctcgccgcctccctccgtccttcacactctctctccggttgtatttctgcctcctcctcctcttgcagcttctcctaccagtcctgacaaaaaagccaagcggcatgaagtaaagagcgacccgactccctttggtgtgcgaggtagagtggcaccctcgggcacggcacccactctgcgttggcaggaagcgcggcccagctggctgtcaggtggccgtcaaggccacctaagggggatgctctcgtgggtctttatgctgcggaggcagacacgcggttgtgttcaatgtgtgatgctctggtgacaggtcctcgaggacagcacgcctctcagccaactcctcacagcaggtctatctggagcctgcggaactgcccaccccgtcggtggctgctggccacggctgctgcgctggtcacctggccgtgctgggtggagctgggtggggtctcactgcccagtggctgctgtcggctatagggcaccctgttccctgcccttccctgtggcacagtttgccccgacacttcctgctgggaacacagagcatagcaactggcagggccgacccggaccctcctttcccggggccaatgaggccgagctccctgtccgacccggaccctcctttcccgggccgacgaggctgagctccctgtggaacctggcccttctcgtttcctgcctcccttatattctcagggtgaaaactgccctgtgaagcccagagacctcccctggcctgttgaggaccttcaagtgcagggacggggctcatgtttgcaatcttgagttttcaaaaatttgcaaaggttcccaggggtgtaagcagaaccagccttcccattccgcccgcctccacagcctcctcacatgacacagcgagcctcacagaaccaggcagaagctgtggccaccctgggcatgagttcagaggcagggagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctcagcctctgcttccgtctcgtcatccatgaatgaagacagtacagccttgcagggtctcgagaaagccagtgtggtgttgaagccgggccactgcccgtgggtcatttccaccgtggtcagtgtggtgtcagagccgggccactgcccgtgggtcatttccaccgtggccagtgtggtgtcgaagccgggccactgcctgtgggtcatttccaccgtggccagtgtggcgtcgaagccgggccactgcccgtgggtcatttctgctgtggttggtggtagtgagcccaggtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacagcgctcttgatggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccagctcctgtgcacacacagcagcccccctttttttgttcccactgtcctcaatcagacttttggttctgtctggccagaggccccacgtgcggtgcctcagagcgactgggggcctggacggggagggcacgctggcagccaggccccacaggccagtccctgctgctgtagaggaggcacctgggcccccacccttgctgtctctcagcctcccttgctgggggcagctgcaggtgcactcaggaggccaagctgcaggtctgcaaccggaaaatcacagtcctcaattctcacacagatgcaggcctggtgtggtgcctggaaggctcaactgcctccagctgtgaccccaagaaggcaaagcacccgggtggggtggaaggagcagccccgtgctctgctggctgacagtggtgcccaggcccagctcccttctctgcacagacagcagagttccgcttagcacaggcttttccttgccagcgcagacgctgtcagccattggaactggcctgcaagacagcttgctgtggcggctttgcaggcacagggcacacaggcatccgtgcacgcagctcctctgtcctccccatgccccacaccctccatcgcaaggaaacgcttgcttccagtggtaccaaataggatttggaaccagtttgtgcccaagctcaaatctcgttagcatctgcctgtttccctggtgtgcatgtgtcctgcctcgatgcatttggcagcaggtgggatgcgctgggcctgctgcctggttgctggctttgcgtgtttatttagccccaatggcgtctcccatctcccccgcatgggaaaggccggtgctgccctctgggagcctggcaggaggaacactgggttggggaggggggcatgtgtggtcccaagtctggaagaagctccttcctcttctcccgctgggagctgcgtggccgatgggagcccatctccaccgcggcacctgcatggtctcagccttccggttcggtgccgctgtgccgggggctactctcttgccagtggggaccacagccctcggtatcccataggtcaagggcgtcaggccctctcagtgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagggcgtggcttcccagggcctggggatcgaggtctcccacagggtggcccagcaattggaagcagatggtctcaaaccctgaaacgtgccaggcattctggaagtttgcaggggtgtcctgctcagctctttatgaacccgggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacgggggctggtcaagtgcagaggagcagattaactcgtccgacgcagaggaggacggcgggttgggccccaagaagctggtaaccacggcttccctgtgggcacttggggtgggggctgccctccggggattaggggtgcttctggcaggtccacccaggcttgggtcttaggacacagccccagctcctcctaaccctggaaggtccacatgggcctgggtcttacgggcagtgccagctcctcctaactctctctggaaggtccacccagacctgggtcttggggcacagccccagctcctcctaactctctctggaaggtccacctgggcctgggtcttaggatgcagccccagctcctcctagctcctctgtctcagcagcactttgtgtttctgggttaatttccaggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaagctgccatgtgttaatcattccagtgagggttacaccaagaagtgtctgctgcaccttctgtgctgtgcgtggtccatgccccaaggctggaggtgcaaaggggacaggtcccggaggctctggaagggcagagaagccaggcgtggaagggtagggagagccctcggggcctctggcctctcccacagagacagcatgaaggaaggcctgggcgtgagaacagatgtgggggacacagaggcggaggccacgtggcaggaggggaaacaggctggtggaacagggtgcacggggcctggggagggatttggatctcattctttgtggggtgtggggagtgatcctggctactctgggcaccacagaggcaggagccagtacaggccatcacgtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaaaggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaaccattatgaacacctttctgccaatatatttgaaaacagataaataggatttattgttagaattggtcaagaagaaatgaaatacttgggttgatgaataacagttacagaaattgcattgcaattaaaaaaaaaattaccccaaacagataccagatctaggtgattttgtaagcatacaaacatatttataaaagctatttaaaagaatataacaagagaaagcaactcaataaagttatgaatcaaatttaaccttggtacccaaacctgacaaagattatgtaagaaaagaatcagctgggccaggtggctcacatctgttcttctagtactttgggaggccgaggtgggagagttgtctgagaccaggagtttgagaccagcctgggcaacattgcaagacaccatctctacatgaaatttaaaaattagccgggcatggtggcacatacctgtagtcccagctacttgggaagctgagaccttacaagtgagcccaggagtccaaggctgcagtgagctatgatgatcatgccactgcactccagcctgggcaacagagcaagaccctgtctctcaaaatcaaccaaacaaaaagacaatgtaagaaaaaataaaattatgaagatgaatgcaaaaattccaaatgaaatataattaagtaaaacccaattctgtgttataaataaaggtaatactttctaagcaagtaaattcatcccaggaatgcaaggggtagtatgttaatgtggctataatttgccatattaatgaagtgaagggtaaaatcaccagcttaacaaatgcaaaacaataattcaatttttattcaacatgtacttgtcatgttaggccaactaggagtagaagaaaatttctttaactaaataatatgtatcaaacaaaatctttgcagcgaactttttttttttgtttgtttgtttgtttgttttctgagacggagtctcgctctgtcgcccaggctggagtgcagtggcgcgatctcggctcactgcaagctccgcctcccgggttcacaccactctcctgcctcagcctcccgaggagctgggactacaggcgcccgccaccacgcccggctcattttttgtatttttagtagagacggggtttcactgcgttagccgggatggtctcgatctcctgacctcgtgatctcccacctcagcctcccaaagtgctgggattacaggcgtgagccaccgcgcccggctgcagcaaaaattttaagtactgaaatcctttagaaccatccccattggcagcagaactgaacggggccccactactctccagcgccatttagccgcagtactagtgactaccaccgcaaaggaaaaggaaacaaggccagcgcggcggctcaggcctgtcatcccagcactttgggaggccgaggcggcagatcacgaggtcaggagatcgagaccatcctggctaacacggtgaaaccccgtctctattaaaaatacaaaattagccgggcgtggtggtgcatgcctgtaatcccagctactcgggaggctgagacgggagaatcgcctgatcccaggaggcagaggttgccgtgagccgagatgtcgccattgcactccagcctgggcaacaagagtgaaactccatctcaaaaaaagaaaaaaagaaaaaggaaccaaggcatgctaattgaaaaataacttttcatatctagaaaaaccaggtgaattcataaactattgaaactaagaagtccacaagatcaacccacaaaaagttattaacattcctagcaataacaatactattttaacagcaacctaaatactaaaataaatgtaacaaaagttttggacaaaattatgaaacatgatagaaggtcataaaagaaggcctaaatgggagatttttatggatgggacaattcagtatcaccaaagtgttaactctcccccaagttaatctgtgtatttcatcaaaattccaacagaattctttgtggaattaggaagttgattgtaataaacatagaagataaaggtctgagtatagccgtggtgattcggggagcagaggcaggaggaggagggctcacctaccaggcatctggatagatcataaacctgtcatcagtcgtgacaagggggagagaggctaaactggtcgagcagaattcagattcccaggcagggatgtgtgcagggacctggcttgtcctggggctggtcaatctttggcacggaatggcctcttcaggaacgggtgttattgggacagctgcctttccatgtggatgatggcataaaagtatagcccccccaaacttaagattaaaacattattatgaggaaacagaatattcttattgcctagggcaaggatagatttcttacaaaagacaagctacactttaagagatggacaaaaagataagatggacaatctgagcacatcccatggtgaatttctctccacgctaagaccccagacaagggtgaaaagcaggaccaaggcccagagaagaaaaattctgctcaaaatcataactgttcaaccttgcatacattctctctcttaaactgaaagttagcatcctacagcactggtgtgacacccggcaggcccgagggctcagctgcctccagctgtggccccaagaaggcaaagcacccgggtggggtggagggagcagccccgtgctctactggctgacagtggtgcccaggcccagctcccttctctgcacagacagcagagttccgcttagcacaggcttttcctcgccagtgcacacactgtcagccattggaactggcctgcaagacagcttgctgtggcggctttgcaggcacagggcacacaggcatccgtgcacgcagctcctctgtcctcccatgccctgcaccctccgtcacaaggaaacccttgcttctaggattgcaccaaataggatttggaaccaattggtgcccaagctcaaatcctgttagtggctgcctgtttccctggcatacatgcgtcctgccgagatgcatttggcaccaggtgggatgtgctcactggttcccaaaacgagaacacatagcagtttccctggatgtttgttcaatactattcccgggacctgcccgtagattccaattccttatgggtgtggaagagcctggaaatcacgtgtgtgtaggtgtgtggcatgtgtataggggtgtgtttatgtggtgtgactttggggtatgagtgtggcatgtgtacggtgtgtgtgagtgtggtatgtgtatggcgtgagtttgggttgtgcgagcgtggttctcatgtacgagtgtgagcatggagattctttggtagggaaggagtcagggtctccctctgtcgcccaggcttgagtgcagtggcacaatctcagctcattgcaacctctgcctcccgggttctctgtctctgggaccacaggcatgaaccaccaagcccagctaatttttttattttttgtctagctttggtcttgctatgttgcccaggttggtctggaactcctttcctcaagcgatcctcagtcctcagcctcccaaagtgctgggattacaggcatgagccaccacccaagagattctgatgtcacagacatctgactcacacactccctggacagctcacgtgtgcccaccaccacagtcagggatggctgcagatgaacaaggtgctgacgtggtttctgtagccccca

SEQ ID NO: 799 - DNA, 117903 bp, Homo sapiens
aagtcaggataaaccttaaacatcgggaatgcaaaatcaaacagatcctttaacacacatcacaaacagaggtgtggacgccccttttgtcccaatggcagggacggggcgctggcccccagggtgtcctgtttatcccctgacccacacagtgtcaggagcttgtctggaggggacggggatgctggcctcctggggtgtccttatctgaaggctgtggtttcaagcatcctccttactgaatttagattttgttccgattttgtggcctgcgtttcttcttactgccctgctctgtggccctgttcttcctgggtttggagatcctcaaggatgggcttcgggaaggcctctggccggatgatctggtgacgtaatcccatctgacgctcagccttggactttgaaaaggcacgactgtcctgtctgatggacaggatgcagaagcctttgggaatgggcattttgccagaataaataaaagaagacaattggcaaaagatggactgtaccccatggccccaggctgctgtgtggagagacttgtcctctcctctgcccacggtcaccagtgagcaccagggacggggtttcctgctgcacctgggcctcttcctgctgccaggagctgccttgctgcctccacctgtgacagtccaccccccataccccccccacccgcaccatgagaggatttccagggcccacccgcctccagtccccgttctctctgctgctttcgaggtcaccctgggctggaaggggtgcctgggatactgctcagacgtcttggccgccctcccaccccgcaacaccccgctcctggttttcaggatgaaattgtcctcaaataaagcaagcttttgagtcaacttgcaagaggaaggaagtttgcttcagtcgtctggttttgttggaacaaagagatctaaagatagacacatggtccccctccctggactgccattgccaggaccctgtttctgtgaggaaaagtcagtggtggggcctcacctgtgtatcaggtgagccaagggcacctctgcccttcccacgcttgggaaatctcaccacgtcgtccccgtagtggccagaagagattggccctcccaggtggggctgctgtggtcggtgctggggatgggcaggggcaggcctggccaccccctcgtcggccccacctgctgcctctgcccgcgtggcaggggaatggacggggcagcctctgccgggcctcagatgtgaggccctaaccctcccctctcagacctgcctctgagcagtggggtcatcactggggagttggttggagcagggctcagtgagggagctgggcctggcctggccttgggtggcacatacgggtcaggggcccaccacctcccagacgtctgacagcacagagccccacagaggccatgctcgcctgcctgcatctcctctggggacctgtctcctgaactgagtggccactattgttcctccgtgcgcttcttagtcttatggctgcaaaattaagtagactggaacttttaaagaaactatgatcataagggcagattttcccatcattcttgagtgggttcaaaaaatcaagaagaatgaaaacttacacacataaatggaagaaacgcccagcgccctgaaaatcccagggccccgcctgcagaaggcctccatgaagaacggaagaaggccaacactctggtgtgggtcagagagcatccacaggcctcttcaggttcacagagtggccagtgaccacttcagatgtagcgatattttagagtttatttgtatgagggcttagctgtgtgcagtttctgatcacacacagggggatccctgcttttcatacccaaaatgaggcatttgatctgagggacaatatttagagtttgtcctggcccagagagtccagaggcactgcgggctgccagcaggtagacagtgcagtgcagatgatggacaggtggtgtggacggtggacaggtggtgtggatggtggacactgcagtgcagatggtggacaggcggtgtggatggtggacaggtggtgtggacggtggacaggctgggtggatggtggacactgcgatgaggacggtggacactgcgatgaggacagtggacaggtggtgtggacggtggacactgcagtgtggatggtggacaggtggtgtggacggtggacaggcagtgtggacggtggacactgtgatgcagacggtggacaggcggtgtggacggtggacaccgtgatgcggacggtggacaggcggtgtggacggtggacaccgtgatgaggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggatggtggacaggcggtgtggacggtggacaggctgggtggatggtggacactgcgatgaggacggtggacactgcgatgaggacagtggacaggtggtgtggacggtggacactgcagtgtgaatggtggacaggtggtgtggacagtggacactgcagtgtggatggtggacaggtggtgtggacggtggacaggcagtgtggacggtggacactgtgatgcggacggtggacaggcagtgtggatggtggacaggcggtgtggacggtggacaggctgggtggatggtggacactgcgatgaggacggtggacactgcgatgaggacagtggacaggtggtgtagacagtggacactgcagtgtggatggtggacaggtggtgtggacggtggacaggcagtgtggacggtggacactgtgatgcggacggtggacaggcagtgtggacggtggacactgtgatgcggacggtggacaggcagtgtggacggtggacactgcagtgcggatggtggacaggtggtgtggatggtggacaggcggtgtggacggtggacaggctgggtggatggtggacactgcaatgaggacggtggacactgcgatgaggacagtggacaggtggtgtggacggtggacactgcagtgtggactgtggacactgtgatgcggacggtggacaggcggtgtggacggtggacactgtgatgcggacggtggacaggcggtgtggacggtggacactgcagtgtggatggtggacaggtggtgtggacggtggacaggcagtgtggacggtggacactgtgatgcggacggtggacaggcggtgtggacggtggacactgtgatgcggacggtggacaggcggtgtggacggtggacactgtgatgcggacggtggacaggcggtgtggacggtggacactgagatgcggacggtggacaggcggtgtggacggtggacactgtgatgcggacggtggacaggcggtgtggacggtggacactgtgatgcggacggtggacaggcggtgtggacggtggacactgtgatgcggacggtgcccccacggtctgtgaggcaggcaggggattgaggacagtgcctcctggtttcctctcaggtcacagtcgctcctggtgagagagaaaaacttaccgtaaaatctgaacatccaactgcgcagtctaggctgccgtcggctgcaccagacacacattccagagaggtgtgcaccagtggaagtcaccttgccaggagcatgagatagtatttcatgctttactgattgactgtttctgtctttctcccacaaaagaagccatcgccgagacgtggttgcgtactgggaatgggtctgtgccctgagctcgccctgcaaggctctggggaagggccttgacatctgcttggctctggcaggtcccatgacaccgtggccctgctgcttcccccccaacaccagggttgtgtctggctcggaggcaaagcagtcccatagctggcagggccgcagccagcacggcccaggaggggcccctttgtgttccactgtgtcccgtgtttacacttgtttgtctgcaagactggaagagcaagatttaagtctgatgccaggtagatattatctggcagcctccgctgggaatttccaggtacaaacacctctgtcccatatcttcaggctgttagtgacctgggtcctcaggtgtggaaaaattgagcgtttaagccattctcaggtcatcagcgtgagtcctgcatcttttagagagaaattgtgtggatgttcaagactgcaaatgtggctatatgatgagagcgttggccagaaatcgtgtctgctccgtggtcagtggtcagtgtcccccaggcacagtggcctggcagccgctctgtagcagagaccaccagcctgtcagtccgtacagctttccctggagggtcttgctggccccatgctcccggctggtgctggctccatgctcctagctggtgctgaccccatgctccgagctgatgctggcctagtgctcccagctggtgctggccccgtgctcctggctggtgctggccccatgctcctagctggtgctgaccccatgctccgagctgacgctggcctagtgctcccagctggtactggccccatgctccccccgtgctcccagccagtgctggcctggtggctgcaggtgctgcagtgcgtccagagccatctggaacctgctgggtggggggatgggtgtgggggtcgaccctgctgttgccatcctgcctcatttgtgtccgtctaatggcgaggccagggttgtggcacagacccccgagggtcctgtgtgtgcggaggcagaggcccattccatggccaggttttcctcctgggccacaagttactgcacctgcaacaggtgcggggcaggggtcgcctgaacattttccctaatgtgggtgggactcagaccaaagtgtatttatccgaggagccaggaccaagccctttcccactgctcccctgcctcccctctgcccaggtctctctctttgtccctccctctctctgtctctcagtccctctctctgaacctcttatatcacactttcaaaattgatggtgaatcactcaacacacagcttttatgcgctgagaaacaaaggcctccacgtattggaaactgaaaagcctttttccagccacgtgacgccactcccgtaggtgcctgtggatgtgccagctccgtgtgggatcgggtgggcgcttgcagggtgaggcagcttcctgggactgacacgtgccgtctgctctttccgtgcagatgaaatcatgcaccaggacatcgtcccgctctgtgctgccgacatccaggaccagctaaagaagcgctttgcttacctgtccggtgagttccagaagctgggatggggtggagagggaggggtctggggccgggtgtgggccgagcagcccccgtggcctggcccaggctggagctgggaagggtcatgcgaggggctgtgtattcactgccttgggtctgacctgtgacctggctctccccatctctgtgaagtgggcagctccatgccagttggcacatggccactgggaggaggtgggtggaggagggtcagggtccccagggggatgtggcctgggcacccctgacagcagcctccagggacagatggagtggtgtgtgggtggccgagcccatgggcctcagtgaaccccagttcctgctgcatctgggcacctcccaggccacgcctctgtccactgtggcctccagccctgcgtctggcacacctgtggaggtggtgcctgcagccatggggacataatgaggctcccagcacccctgtgtgggtacagcaagggcacctgcagtggccccgagctatgtagatgccgttcttatgtgaacaaatctgcccaacaggacccgtcagaaaaaacaccatgcacatgcatgcccaccctgggccatcagggtgccccgatgctgaggagggtgccccgatgccgaggagggtgccccgatgctgaggagggtgccccgatgccgaggacgcggtgctcttgggagctcagcctctgcccctctgcattcccgtcagcatcccggcccccaatccatggctggcacggtggggcctccatcccgcacctgcacctacagagccagcctgcaccccaggccgggccttggggtctgagggaggctgactgcgaggtgcagctggtgagttttatgagaccaaaatcgaagagacagccagcaacatgatggccagaggagaagtgctgtgcagtgacttggtccctgcttcccatggccaagtggcccaggaggaggaaggagagaaagcagggggtctctggagaactgaaaactcccagaggacaagggctccaatccccctgtgtcggggaccaggcgtggtgatggctcaagagaggcgccgtggtttctgccggttcctcctgcgtccccagcctctccccgcccctttcacaaccccaaagaggctcacagctttgccaccaggagggccccgacctgggcctccagccttgaccttcctccagttgccaggcagtgcccccaccccagcggtgcctgggagggcagagtcccaggacggccccagccacccaccttttctcgatcgttcctcagacgccagcccaggagctctgggggggattttgcagatgaatttaaggccccaaatcagctaactttaagatcttccttggtgggcttgacccactcagctaagcccttagaagagatggggctcttcctggcatgagggatcccaggtgcaagaaggatttgacacaagggggttctctgtgtggccccgaaggaggcagaggccgcctgaccaggacaagagccgccccacgggcagccgccaggaacccggggcctcaacactgcagctgggggcacagctctgccaagcccctgggggagctggagagactgggctcaggatcacagcccggcaacccctccacgtgggcccagagaccctgagcagagacccgcaagctgataagtgcctgagcgtcaatggtcttgggaaccacaccaaagcctccgtcggctcctctccctcctggaatataagatggagtcccctgtggtactgctgcccccgcgtcatatgctgcccccgcgtcgtatcctgcccaccccctggaggcaggctgcctccccatccccctgcctcccgccaacctcggggcctttgcacagccggccctctccatgcagcgaatttcttccgcggggcttgtggctggcccggcccctcaggccttgctcagaggcacgccctcgtacatgccctctccctcctcgcctgcgctctgctccgcccccttcgttacaccacctcacgtcctcccgtgtgtggcgtgggtccctcctgagggctgggtttgttcacagctgcctcccggcttctagaggtgcacccagcctcagagccatgtactgagggctcagccatgggcccatctggggtgggaccctggcacaccacgctgttctcaggatccaggtcgtagcagcagtaccacgtctgagaaggatcagtgtcggctggcgcttctcctgcagatgtgcgcggatttggaggaagcctgtggcagcctcgggtgtgtgcgttgccaatcgccccgtcccctcctcaccacgtccagcactgctgtgtcctgaggctgcgcctgcactccgggttcctgccatgaagcccccttttgtgtcctcatgacaaaggccatgcactgggggaccgaaacaactggggctcgtctctcaggttccgtggggctgtgccccttccggaggctcctcctgctttggggacgcaggtgttccttggtgtcccttggcatcttcatgcagccgcctcacctgtacgtcggtgtctcctcttctgcctcaaagcccctctgcctttctcccgggacacccgtcacgagatttagggcccaccgtataatccattatggtctcaccctgaaaactttgttacctctgctgcaaagacttctccaaacaaagtcatgtttacaggctcctgggacagggagtggacgtgcctttcaggggccgccttggactcagggtaaatctggctcagaggtttgctgtcttgacagctgccctcaagggggctcccctcccgccccagcatcacccatgggactcgctctccctgtctcgctccactcgaaggaaacacagactcccccgcccgccactcctgcacactgaccaccatggggctggggtccagctgggtgaggcccctcattgtgactggagcccacaggtcgacaccccagcctgttccgtggacttttgcttaattccctggtctttggatgcctggaatggcttccgtgaagtgccagagcaaaaaactaaagatgtcaggaaggaatggctccgaattttccttttcaagaggagactgcgtttctttccacttgccctgctgatttcccctccctgcgacgttcgtgccagccctgtgctgtctgccgcggagccatggctgccactgtgacatgtgcggtcccgtcttctccctccattgtctgtagacgcacaggtgccacgcagaaccctacagctctgtccagatcctggatccagatgaggcagcttttgaaaggcggccaagtgagggatgcgtaaacctcgggggctccggactcctgtacgttgccgcccaaagtcaggacgagctgcggaagtcacacctggactctgtgtctgtcatccgcagacagcagctccccattcagcctgtgtccctcgtaatccacaccctctactcacagtgacatctgccccaaaagcgcttcgcttaaccctgaagctacgagacctgccaccctactgtcccctctagttttctgacatttgaggaacaaggaattgggtgtaaaatcaggaaatatcctacatgtaaattcttgattattcttgtccttccgggcagagctgcctcctgagtcatccgtttgactctttcttactgaaggctgagggttggggggtgcatgggtgctccaaacccagaggcaatggcgcgtcccctggcatggcagtcggagcaggccccgaggaggtcgtggtctcagaactcagtccttgtgtcatcctagaaaagatacttcaacttgctgaccgtcagcaagagctaaaaacagggcgggagaatttaccactgaggaacttatgatctgaagtgaaaaacgcagagaacagacttgccaccggtgaaaaccacaaagctgaaatggaggccctgcccggaacgcagaggccaccgccactgtgcgtctcactccctgcaatggacggcggcccccctcccactgcccaggcggctcttgggaatttcgttttgcttttacgggaatgtggcatggtcagcggtggccatcagccatccaggaacctggatttgacaggattgctccatcccatgtccaggcagcctcaggtgtgtggagacagggcagacttaggagttcctcccctggcctgtgctctcctcccgggaagaacgctggagaccttcgtctcttctcctttcctcaccttccccaagcgctcgctgcacaagccccctcctgccttgccccttctcccaccccatttcggttttggtcccagcttacatctcgtcctaaggattaagtgtttgtgcagctgagccgcagttctcaggtgagctgcagggctccagcatggcacctgcctgggcagtcctgagagagggattcgaagtggggaaggaccccggagtctccctggcacgtggtctgaggctccagccaccagacccgaagctcagtctacactcaccaaggcccgacggctgctccaacctgggaggaccgatccgatcctgcgctccctgaggccgatggctttttgacacccaggcttcagccacagacagacagacgttccctgcccgtgggggtttgcccttgctggagagaaacagaaatggacagaaggtcactggggtggccctgggtgttctgcggagaatcaaagtcatgagacggagacaggaatcccgttaggtttgggcagagtcgcacgtgctcctttctggacctgcttcaaggaatccgatggtttcacgacatccaaccagttgctataggataaatgtttgtgtccctccaaactcagatgttgaaaccctaaccccagaggtgatgtttggggaggtgaggcctttgggaggagattaggtcatgaaggtggagctcccaggtgggatcagagcctttataaggggctgaagagaccagatctccttccgcagcatggccatgcctcaaggagacctctgaatggggaagccgccgtcaccagacaccaagtctatgggcaccttcatcttggacttacctggccagagctgtgagataaatttctgttgtttgggcctcccggcctatggtggtttgttacggccgcccagacagaccaacaaacagcctgtgtgaaaatgcgagccataaacgagtggtgttgacaaaggcatcctgtccaggtaggagttccgtgtggctaagtagtgtctagtttcagaatgtgatgccttcttgatgtcatctccacactggcaggaggaggtttttatttagttcttattttaagatttttctacccgacagttaacttaggatacagatgtcatagtaaattaaccactggaatgctttcattcctaagcagctcatgtgggtgagtttctaaagccgtgtttgggccgaggcatcacacaagagggtgtccctaagatgcatcacgtccgtggagaaaacaaagcaggacacacgtgtgagtcgtcacacccttggtcacccggcttggccgtcacacatgcctcctgcccaggacgcgtgtgcgtgtgtgtatctacctgtgtgtctcaactcaggctgcttgctgtgacaaagtcccctagactgagtggtttaagccacagtttatttctcttggttctggggcaggaagtcccggatgaaggcaccggcagatgtgctgcctggtgagggctcacttcctgatttacagactgcagccttctcgctgtcctcatgtggccaggcgagcagagcaagcccacagaatcccattcacgggagccccactcccacggcctcctcccctcccacaagccccacctcccagcactgtccccgtgggggtcagcatttcaacacatgaattcaggggaagacagacatccagtccataacagtgtatatgtgtagctgtgtgtatgtgtagatgtgtgtatgtatagtgtgtgcgcgtgtgaatgtgtagctatgtatgtttgcatgtatgtgtagtgtgtatatgtgtgtatgtgtagatgtgtgtatgtgtagatgtgtgtatgtgtgtgtatgtgtagtgtgtatgcatgtgcatgtgtagctgtgtatgtgtatatgtgtgtacttgtagatgtgtatgtgtgtgtatgtgtagctgtgtatctgtatggtagctgtgtatgtgcgtgtagctgtgtgtgtatatccatgtgtgtatatataggtgtgtatgtttgtacatatatgtacatatacatacctacacatccacatgcatatgtgtgcagctgtgtatacatgtgtgtgtaggtgtgtgtctagctgtatgtgcagctatgtatctgtgtatagctgtgtacatatgtgtgtgtttataagtagctgtgtgtgtaactgtatgtgtgtatatgtacatgtatgtgtgtataggtagctgtgtgtagctgtgtgtgtattaaactgagtgtgtatctcacactaaagcagatcccgtaggaaccacacttctttctggtgatggggatgagagggagttgcatctgccttctgcccctagcgagtggatgtaggcccagttgcttgggtgcgagagttcacatgcaggtgtgacaggtctcagccaggacagtggtttttggacgtgggtggggaccggaggctgcccctggtgctgtgtggacagggtgctgttctgaaccacagaggagcttcggagccctctgtcctctgcggcgttcagtccgcctccagttactaggccgggtgtagacacagaagtagagcctgttcttggtgccattggccccgggtcctggcactgcccaccttggtggggagggtttctccagagaggggctgtgcccccagctccgcgtccagcggtgttttgctgcctcataacctgcaggtactgggagctttggcgcctgcttttcagtctcagtggacagactgggatttccactcctgacttgggaagaaagaacagggtctttgctttgcattgaggctgtggtggagcacagagagttcagagatacccagggtagcagcagcctgagaccagcaccagctaccaactgaacgaggctgtgcggcccaggccaggcccccgtgcgatttcagctccgggtcacctggcccccatcctctcccctgggcagctggaggctccaggccttcctgtggctagctcctgccccaaggctgccctgctgactgcaccctcgaccctgtggctcaggctggcctctgggggtccccggtctctgtggttccagtgaggcagcagctcccagatgccacctccacactgtgggtgggccagccagtgctgagagggagccactctccacctctgtgtccaccatccactccaagctcccaggctgcctccacgttgtgtccaccgtccactccaagctcccaggctgcctccacgtttgggcatgaggggatcttgttgcatccgctcctcttcctagctgggccctccacagccagtgtaccccaaggagcagcttctccctcccacccacccccgccggccaggggtcctcatgccgtggcccatgcccatttgcacagggacgcagggggtctcacacacaggcagggtccgcccccagctgccgtcggcgtcactccacacacataggcttctgggcggtgctggaagcttctggcccctgaacgttccccccaggccccgtttcagggaaaggaaaggcaggcgcaggctgcggccgtttccacaatccacctcgtagctggggcgtgccgcttgcctcggcttgtcccggcagaacactcttacctttaatggcgactgaaaagttgccacgagttcctgatcattgtggtaggtgctgcgtgaagctgagacgtgcgtgagccacatcccagggggctttgagcccccaccgcggcggcggctgaggggaggcttgtcgtactcgcacaggaggacacagggctgcagtgttcactccagggcctcttatcattgggatctgaggaattttccgagaggaagtgcgaattaacaatgatgaaaggtttgtgagtgagtgacaggcacgttctattgagcactgcatggggcattatgtgccaccagagacgggggcagaggtcaagagccctcgagggctgggagagttcggaggatagaagtcatcagagcacaatgaagccagaccctgcagccgccttccccttcgggggcttccttagaatgcagcattgcggggactgagctgtcccaggtgaaggggggccgtcacggtgtgtggacgcccctcggctcagccctctaagagactcggcagccaggatgggctcaaggcatgagccctcaaaggaggttaggaaggagcgagggagaaaagatatgcttgtgtgacgtcctggccgaagtgagaacaattgtatcagataatgagtcatgtcccattgaggggtgccgacaaggactcgggaggaggccacggagccctgtactgaggagacgcccacagggagcctcgggggcccagcgtcccgggatcactggatggtaaagccgccctgcctggcgtggctgggcttggccaagacccagaagcagaagttccggaagctggagacagtggctgtggggggcgcaaggcggcgggggactgtcgctgttacgagacaaagctgcagttgtcggaggctgtgtgcaccctgggtcttctcagtgaggacgtggatgaggggcggcgaacccaccattatctgttctccataaaaagctaccctaaacttagttagcttgaaaagccctattttacagatttattcttcatttagtggctcagaagttccaaaagggctcagccaggtggttcttcactccacgcacggggcactgactgtgtcctctgctcagctgtgtcctcatgggggctgggctggaaggtcctgggggctgcagtcccgcacctccacctccctgccctttcacaaagtccaccctcaaccctgggtactggcctcctcagagcaggtggatgcagggtcgtgggaccacctgcccaatgactacagggcatgagagggcagctgcagtgttctgagtcccaagctcacttccgctgagtcctgtgggcaaaacagatcgcaaggccagacccaggctcgggggagggaaatggactccgtccggccaaggcagtgtggcagggtcagtggccggctccagcaggcagacctggagcccagcctgtgtgactccaaagtcagtgttcgaatggagctctttggaattgaattgcttaaaaggcgccaatgtcggagaagctagacgatacccacaaacagtacagttaggcaggttattagtgcacatgcatatatggaatattatgcaatatttaaaataatggttacattgtttaaaagcatggaagcggtttgttctcagtgtcaggaaggaggcaggagacaagcttctctatgcagtatcacctcaacaaggttaaaaaagcccatagaaaaaggcttggaaagaagcatgttgaattgtcacggtagctgtcccatggtggccaaaataacgagtgattgtctaaattcacatcacttttgtgtactttccaaatattttcttcaagcagcacacatttctttcaaataaaaattatgcaacgatgaagaacatgcctcagttttaactgaaatactgggtgctgatgaaaacgggccgacatctgtggaacccccgggggcatggagccctcggctaagggtctgcctctggtctctccccaggtgggcgggggcaggacggaagcccggttatcaccttccctgactacccggccttcagcgagattccggacaaggagttccagaatgtcatgacctacctcaccagcatccccaggtacgtgcacccagagcccggcagacattgtggtttggggcagagtccctgtgagatttcaccagggtggggtccctgcaactatgggatgaggcagagtccctgtgagatttccctgtcatggggtccccgtgactgtgggtcggggcagagtccctgtgagatttccccatcatgcggtccccgtgactgtgggtcagggcagagtctctgtgaggtttcatcatggtggggtccccgtgactgtgggttggggcagaatctctgtgaggtttcatcatggtggggtccccgtgactgtgggtcggggcagagtccctgtgagatttcaccagggtggggtccctgcaactatgggatgaggcagagtccctgtgagatttccccatcatgcggtccccgtgactgtgggtcagggcagagtccctgtgaggtttccccattgtggggtccccgtgactgtgggtcggggcagagtccctgtgagatttccccgtcatggggtccccgtgactgtgggtcagggcagagtctccgtgaggtttcatcatggtggggtccccgtgactgtgggtcggggcagagtctctgtgaggtttcgtcatggtggggtccccgtgactgtgggtcggggcagagtctctgtgaggtttcatcatggtggggtccccgtgactgtgggtcggggcagagtctctgtgaggtttcatcatggtggggtccccgtgactgtgggtcggggcagagtctctgtgaggtttcatcatcgtggggtccccgtgactgtgggttggggcagagtctctgggaggtttcatcatggtggggtccccgtgactgtgggtcggggcagagtccctgtgaggtttccccattgtggggtccctgcaactatgggatgaggcagagtccctgtgagatttccctgtcatggggtccccgtgactgtgggtcggggcagagtccctgtgagatttcaccagggtggggtccctgcaactatgggatgaggcagagtccctgtgagatttccctgtcatggggtccccgtgactgtgggtcggggcagagtctctgtgaggtttcatcatggtggggtccccgtgactgtgggtcggggcagagtccctgtgaggtttccccattgtggggtccccgtgactgtgggtcggggcagagtccctgtgagatttccccgtcatggggtccccgtgactgtgggtcggggcagagtctccgtgaggtttcatcatggtggggtccccgtgactgtgggtcggggcagagtccctgtgagatttccccatcatgcggtccccgtgactgtgggtcggggcagagtctctgtgaggtttcatcatggtggggtccccgtgactgtgggtcggggcagagtctctgtgaggttccaccatggtggggtccccgtgactgtgggtcggggcagagtctctgtgaggttccaccaggctggggtccccgtgactgtgggtcggggcagagtctctgtgaggttccaccatggtggggtccccgtgactgcaggatgaattagggtctctgggagccatcattgagttccccgtggctttgctgaggggttagagctttgtcagcatcatggttccgaggagctcaggagtctgcctcagatctgatctggggtccgaatccagctttttcgctcctgagctgccgttttttcctggagctcggaggcccacctggaggcccagttgctcagcagtcgggatctgacttagcctgagcgctgctgtgctccctcgtataccatcactgcgcatgcctgttcgatcagcagagttctgcggtgcgagggcttctgtgttcttaatgccgaggagcccatctgcacgggacctgatgctcatgggagcagagcccgtccacgtggcctctctgtgtcgtggtcaggccctgggggcgtggccgcctcctgccctttccaggaaagaactgaccccagaggtaccagaaaatccagttaacaaaaatggttccctcaggctgcagttttttgttttgttccagacagagctgggtccctgtcctctgaaaaggtagggagcccagttctgtgtctccccagcggcgggcaggagagcagcatcaggccggtgagctgcaggctgacttgggaggggtgccgcgggggtctctcatctgatgtgctcgtcccagcctccaggaagatgctgagaatgtcagcctcacaccagacagtgtagttgctgcttccatttggggtatagtgaacacacaccaagtaaaaacagaaatatccttaaatatggcatctgtatcccgcacattacataaggtggcaaaacacagaggagatgtttaaccatcagcgtgaaagtgcagccgtggccattaccgtgaaggttcttcattcttcagtctttaaagacaacagcgcactgggcctggtaactgagagctcagcccgtcggcctgacctggaaagcagcacattgatcccctgataaatatcacataaccaccagctggcagcagccagcctctgcagtcatgcctcaaggagagggagagcggtgggcacctctgtccacttggcgggttgaggtgggagctggaggagcagggagcctcaccggtgggcctttcgggggcaggacgtcttggtgggcagaaagaagggggctcgtgactgactatggtcaaagccctggacatggcggtgtcctggtagccccaaatcactgtgtgttgggtttgtggttttgacctcagtctcttgtctgttgtgagaatcttgcaccccctatgcgccaggctctgctggctgagctgagtgcacggaggaggggctgggtctcgggccgagcggccgagctccctgaggggctgatgggaccggcttggtggggcaaggctgcgatgctgcagacggtttccacacattcctccctggttctcagccacactgtggcaggaaggcagttattaagcccatgttatagatgaggcttaataacacggtgatggctggagaaaggggatggctgggcaggggagcgcccgaaggctcagaccacatggccgtaccccgaggacgtaggctccaggtgtgctgtggccagaggggtgtcctggggagggcggtcatctccaagcctccaggcctttgtctgtcacctgcacaggaggaagggcctgtgtcccaggggacggccggcctgacaggtacatccgccccctgatggcacctcctggcatggggctaaatgagattctgtggtgtccacactgaatgctgactggtcagactcatgctcagaaatcagggctgttgtcagtgcttgctacttggagccatgagctggggcgcctcctgtttgttgaaccttcctgtctcttttgtcttagaaacttcatggagtcccttagctacccacatccctttctcaagatttttctagaatctgcggagttccttagctacccacatcccttttcttgagatttgtctagaatctgcagcactcaaaggccacccatcaaggccataagagtgtggtaggcggcacgtgttcatgtgtgcacgcctctgtttatccgatgttctggaaccttccatggcctccttgctgctgccccacttgtctgtctgcttctcctgagatccaggaatctcagatgggtccagactcctgcaggacaagacccactcagccacctctgtagattgcgcatctgtgagtcgcacagcctggtctggctgaaggtggccggagcgcaggcccagtccccgctgtggacacgcgggccccaggttgctcagaggcagctccatggatccccactgttcacctgtgtatggaaactcaggttttctggtcacacttagataataaaaagtggaagaggcctttctatcaccaaacgctctaaatcagatcctggaaatgccagcttcattcagccatgagcagtgctgctgaccgtggagctgtttcccccaccagactcagtgtgggtgtctgagtgtgtggtgtgagtgtgtgtaatgtgagcctgtggtgtgtgtggggtgagtgtgtggtgtgtgtggcgtgtgcggggtgtgtgtggggtatgtgtggtgtgtgtgtaatgtgagcatgtggcatgtgtggggtaagtggtgtgtgtggtatgtgtggactatgtgaggcatgtgtggggtgagtgtggggtgtggtgtgtggggggtgtgtgtgagcgtgagtgtatgcgtgcattctacccacgtttcctttcttcccaggtaggtctcatcagtgtcagacccaatgctccctttctatctggaaataaaactctttgataacaaaacccaacctgtgtgaatttgggaggacgcccatgtgccctgatcagaaggacccacagaagggaagctgcgggcctgtaagagccacctgtcccctggctgtcccggcatcctagggcgcagcagccgcggcagctcccctggatttctgtgagcacggggctgcaggcgtgctgtggggaccccgtgcctccagggtgttgccattgagcatgtccttccagagagagtgaacaattcttgacacatttctaagggaaatcttcttcctaagggcatctacgggatgccttcttgagaagtgcagagtgtgttaaaaatgtgggggtcaatcatggcctctgcagataaaaccagggtccctgcaagccttgcaggtgcagcttggcagaggggaccgtcccagaggaagtctctgcatccctggcgagcaaaattgccaggctagtgacaaggaggagacctgcccactgcgccctgagggtgctgtgtccccgggaagtaccctctgcgggggaccctcttcccaaggtgggggcggggctgccctctgctggagacgcggagcattgcggctcggtcccgggacatccctgggagaccaagagagggaggggagcttggaccttttcttccaggagatggtggacgagaccctggcacaggcggttccccagcacgcagtttccagacagctgcacagccagcacattctttaagtgggaaaaaagtgaaattgaccaggcctgttctttcacatgtcaatgcaaattaaatggacaaatctctcgtgaaggctgcttttaaggggtttcaactgttacattctaaaccaagcatcacttttatcaatttagaaagaatgttgtattctaattttaactttccttctgttttcatatgcaaatgccaggtgtcccaatttaagcactacatctgactatactcatcatttttggaatattagactgaaataggtttgccccaaatggtttggggcacctgttaatataaaccaagtttttggtccttggaaagacgactcatcagggcgaagggggtgagctcgtgctttgctgactcaggtgtctgccgacgcccggtgtggactctcaggtgtccgctgacgcaggtgtggaccctcgggtgtccactgatgcaggtgtgggccctcgggtgtccgccgacgcccggtgtggaccctcaggtgtctgccgacgcccggtgtggactctcaggtgtccgctgacgcaggtgtgggccctcgggtgtccgccgacgcagatgtgggccctcgggtgtccgccgacgcccggtgtggactctcaggtgtccgctgacgcaggtgtgggccctcgggtgtccgccgacgcccggtgtggactctcaggtgtccgctgatgcaggtgtgggccctcgggtgtccaccgacgcagatgtgggccctcgggtgtccgccgacgcaggtgtggactctcaggtgtccgctgatgcaggtgtgggccctcgggtgtctgccgacacaggtgtgggccctcgttcgtcagagggcaggttcggatctctgaaaaccctatagcccttcctactcctaatggagctccatttaaccaacatcggccaggccttgataggagccaaggtctcagagaggcgatagagaccagcgacaagcagattccagaccctgtatggcccccttagaaccacatggccggggaggagatgcacaggtagacggtcagacctgtgtgtccaggcactgcttgctgagaagtctcagtggtcagcacacactgggaacacaacagcaaataaacagagaaaattgtggcgctgagacaatatgtcagctatggagggcgtacagggcagcagggctgtgggaaaacaatgtgagaaagaaagagagacagagagacagagacagacagatacagacagagagacagagacagacagatacagacagagacagagacagagagagacagagacagagagtgacagagagacagacagagacagagagagacagagagaagagacagagagtgacagacagagacagagagacagagacagacagagacagagacagagagagacagagagaagagacagagagtgacagagatagagacagacagacagagacacggagacacagagataaagagagcacgagggaggcagagggcaggggtggcagcatcactgcagacaaggaacttaatgtaaactgggaagcattcgtcacagagatcccaggagggcgccagcggcatctttgggggcagcgaacgcaccagggggcaggacagagtgccggggagtcgggggctgtagggacagagtctgggaggtgagacagggtctgtggagccttttctgaggagctgtgttttctgtgaagtgggtgccaaagagttcatgagctgccagaatgcagggtggagggagaatgcggggtggagggaggagctgggagatggggaggagggcggcggccctcagagaagggacgaggtgggaagcctggagcttgctggaggagcagtgtggaaggaattcactgaagctgatgatgacgcttactttccatgggcctggctcaaagctcccagctccttgggaggtagggactccatctaccagccagcttgccgggacaggggtcacattcagcccataagaggcatgtacacatacagatgcacacacgcacctacacaggcttgcacatgccacacacacacacacacacacacagatgcacgcagacacgcaggcactcatgcacttacatacacagatgtgcatgtgtataaccacacacgtgcgcacacacacacatgcaagtgcatgcatacccccccacagacctgcacatgtacacaccacatgcatgcacagtttgtgtggtgtatggggagggtgcatgtgggacgcaacagaaacacgaatgtaatcattaggcttccagtcaagaggagagtcctcctatctcactgattctaagataagcacctggagccaactcggtttgtcgtccccctgcggtgacctgagcaccctgtcctgctgtctgagctggagggcagctggaccccagcccttggaagagccccacttctcgctgtgggtttgatttcctattgaactttgaattggcttttgaatataaggacaggaagtgtctgtgagcgtgtgtgagcgtgctaaacaatttaatacgtgtgcattaaaaagtgaagcttccacttcacctcctgcttccctcccccacagctaactgtggagctgcactggggtgacacccaggctgttcatccacgtgtggtgggacagcacaggacatgccgcctcgcagcttgctgcttctgttcagcggtgtgtcgtggcgcccttctaccttggcgccatttgctgctgcctttcattttatatatttttttttcatgttttgagacagggtcttgctctgtcacccagactggagtgcagtggcaggatctcagctcactgccacctcaacctcctgggcccaaggtgatcctcctgcctcagtctcctgagtagctgggactgcaggcatgagccaccacacccggctaatttgggtattttctgtagaaatggagtctcaccatgttacccaggctgatctagaattcttgggttcgagtgatccacccaccttggcctccaaagtgctgggattacagatgtgagccatcgtgcccgcctgtgccttccttttaaaggcttcctggcccctgtgatgtaagcggacctggtgtgctcacttgggctggcccccgtgacgtgagtggaccccgtgatgtgagtggaccctgtgatgtgagtggcccccgtgatgtgagtggcccccgtgacattagtggaccccgtggcgtgagtggcccccatgacgtgagtggcccctgtgacattagtggaccccgtggcatgagtggctgccatgacgtgagtggcccccgtgatgtgagtggcccccgtgacattagtggaccccgtggcgtgagtggcccccatgacgtgagtggaccccgtgacgtgagtggcccccgtgacatgagtggcccccgtgacgtgagtggcccccgtgacattagtggaccccgtggcgtgagtggcccctgtgacattagtggaccccgtggcgtgagtggcccctgtggcgtgagtggcccccgtgacattagtggaccccgtggcgtgagtggcccccgtgacgtgagtggcccccgtgatgtgagtggaccccgtggcgtgagtggcccccatgatgtgagtggcccccgtgatgtgagtggcccccgtggcgtgagtgaccccgtgtgctcacttgggcctgttcgcgggcatttcgtggtccccactgtttccctgttggggtcactgctgtaaagggtcgccccgccatggtgttctgtctgtgagattgtgccctgtttctggcagttctcaaatgctccagctgggtgatttcccccccccaccccaacggagttggcagtttcagggctacccttgtctgccatctctggctggcctgaggctgtgctggccccggtcgccctccatggtctgaagccctgagtggaagctctgccacccacagccagcctcgttaggaggaaccaggagacatcacgcggcccaggtgtctgtgcgctgtgctgggtgggaagccacctctcaggtgtgtttcccgtctccacatcagcattttgttcatggagtctgctgcttctgagcactggggacaagtcgcggaggccctgccattccttcctccgggttctgcacgcaccgcggtgaccacctccccccgaggtcctctccccgcaccttcccaaaacgtgttccccaggtccttttctgttactgctgttgaattcaacagctactgaccacctgtggccatttaaatgtaaaatgaaagcaaaataaaattaaaaatccagcccatggcaggcagggctgcctctttttttttttttttttttggagatgcgtctggctctgtcgcccaggctggagtgcggtggcacgatcttggctcactgcagcctcaaccttcccagctcaggtgatcctcccacctcagcctcccgagtagctgggatgacaggcgcatgccaccacgcccggctaatttttgtattttttgtagagatggggtttcaccatgttgcccaggttggtcttgaactcctgggctcaaatgatccacctgcctcagcttcccaaagtgctgggattactggcgtgagccaccatgcccggccaggcagcctcattttcattcacacatgaccaatggctgcttattgggctgcacgatggttatgctggctccgtcctggaggagtgagtgccctcaccctcaccctcaccctcgccctggtctcaccctcgccctcaccttctccctcgccctggtctcaccctcgccctcaccctggtctcaccctcgccctggtctcacccacgccctcgcccttgccctggtctcaccctcaccctggtctcaccctcaccctggtctcacccgcgcccttgcccttgccctggtctcaccggcatgagcagaaagacaaggcccggggttgcagtgtctgtgctcagggtccagacacagctcagaaccgaccttccttggggagtgacagtccccggaggttaggggctgctgtggccaaagagccacagatcggaggtgaggaaggtctgcccgaggtgaggaaggtctgcccgaggtgaggaaggtctgcccgaggcaaggcaggcccgcagtcccgggcggtggcatcagggtgagcgccctgatagcaagggacctatggcgcccacaccggagggcgggaaaaggaggaagagcatggcccccgtgaagcccctcgggaggaagggttcctgtccacgttcagcacccccgtgcagacctcaccattcccgacgggaacacttgtgatattcacttccaaccacacgagggtgcagctgggcaaccgcagcttttggaaaaatgttgaaactggggcggcttctctgggtgactctgacgctctcattgcttcacgtttaatttttgtgtcctgctgtaactaccatgtagtgcacttatgaatcgtgcatattttactctaaggcctgtctgtaaaccctaataaatgaccctactcaggtaagacgtcctgacagtgaggtttttaatatttacaagccacagaattatttcctgcagccacagagacttccttggcgggaaaccaggtcctctgacctcacccggctctgcagtctgttttgccgttttccgcctcaaaccccctctgcgatgtgcagctctgggtgtctgatccctcaggggtcctgtctcccctcctctggccccctccctggctccttcgcctgctgcctttttcttccatgaggatgcggttcccgtgtcccccaggacagcttcgtggccggccgcctccatggattcgggtgggcacaggtcctgcagggagctcctgtgttatctgccctccccgcgaagctccttggaggatggagattttaaggtcttactgtggtgtgagcgatcagagaccccagtgtttaccaggtaggctctgggctcagaccccagcgccccacttgttagctgtttgaccctggatatgtcattcacttctgcgttcctcagtttctgcacgtttaaaatggcagaggcccctttggtagtgagtctgtgtgacaggcgatggggccttcctctctggtacagcaggggcctaagggatgtttgacctcagcaggtagagtatcatctccgtggtacagcaggggcctgagggatgtttggcctcagcaggtggaggatggctgcaggtcaggattttgcatcacaaacaacactgctgcagtcacattagtggattttgttattatagacaacactcgtgtctataattccaaggacccattctccatgcccagaggcacctcagtcccacagaccgcagcctgattctgagttcgcagttggccagtgttgcagaagctcacagaggagtctttggaaatgagaatgacgccaccattctcttttaattgtgtcataggtcttccttccttttatacataagttaactgaggctggtttgctttccacagccagagttctaagacaattttaagtaacacttttctttcgctatttctttatgaatgtgttgggttttagggatcacagatgtgcttgggcaaccaaggctgcctgtgtctctgtgctctggggggcttttcctacgagctttgcgtgagatgccagctgcccacaggcaactgggcacagagagcaggagaataaagcaggccagggcatcaggtggggctgattccatggagggcaacggcagtggtgggggcaagtgcggggtgggtgagtggcagcagccacccacagaaggacgcgctgtcccggccccgcatccccaggagtgcgtgtgtcgcaggcgaccctgtcctctcacccaggagccctctgagctcgcgcctttcttcaggtgtctgcgatatcatgctccccttgtgttcctcctgcctcctggctgctgccagtgggtggccccccaactcctccaccagaccctgactctcagaggactccaagcctctatttgtgttattcctatccagtccatggggttcagataccaagtggaacttttaacaaccatgaattcctaggcctcactctcaaatcatcacatcagaatatccaggagtggcccgagaagacctgcgttgtagcaagctcccggatgtttctcttgcatccatctggcactggtctgcacactggtgtttggaacccccagacttgaacttagtgccgtgcggtccagcggccctcctgtccatctcagtgcagagaggggctgggggaggtgcaagcgtgtcatcctagaagaattcctctcgactaacagcctgccgtgttcttggcatctgtgcacagtggagccccacaagctggctgaacccttggcttgcgtcctaagctctgtgtgctgttaggatgatgataacgaccacgatagaaagcaccttgctgagcccctaggagtagaaggtggagggcaggccagggcagagttgagctagacagagtgaagaacacaagttctggggaagcagggaattgtaaccaaagatgaaaccacccctgcccagcggcaccatttgtagggaccttggagagttggttgaacatctgcagagcatggggtcggagactcaggtcagactaaactggttcagagccaggatacccctttcgacctgggttacatttgtcatcattcatgtaaatgtttctgttagatggaaacaggttcaaaacccactacctacttccattctggctctaatagagtatcttgtagccaactgatatttccacaaagagcaactgtaaaacctgggtaaaattttgtttaaaaatatgtttgagggattgagaggctgcagaggcagccaggacttggggagccaggttctggaattttacagaggtgagccccactttctgcatttcatggtgaggtattgaacgctttgccgctgaggtcaggaacactgttctcatttctattcaggattgtgcttggaggtaccaggcagacaacaagacaagaaaagaaaagtcttaaggattgaaacagtaagaaacacaggtatcattcattatttgtagacaatgtggttgtgtatgaagaaaatccaaattaagtaacagtcagactcttaagctgagtaagtaatttagcaagatcaatgggcaggggtcaatatactaaacttaattgtattttagtatttttatatatatcaatgatgtacaattggaaaatgaaatttatagatatcacttataatcacatcaaaattgagtacataggaataaaatcatatctaataaaagacgtgcaagacttctaagcagaaaactgcaaaatgttattgaaagaaattaaaggggccaggcacagtggctcatgcctataatcccagcactttgggaggccgaggtgggtggatcacgaggtcaggagatcgagatcatcctggctaacatggtgaaaccctgtctctactaaaaatacaaaaaattagcagggtgtggtggtgggcacctgtagtcccagctactcgggaggctgaggcaggagaatggcctgaacccggaaggcggagcttgcagtgagctgatatcgcgccactgcactccagcctgggtgacagagcgagcctccatctcaaaaaaaaaaaaaaaaagaaagaaattaaagtagcatgaataaatggaagaatattttagttcacagattagaagacaattagtattataacaatgttaattctctctaaataaacatatagatcgaatgcagttcccaaataaaattccagcaggtttttctttatttaggtgtgaacattggcaggctgcctttacattttatatgaaaatgcaaggggtgaggaatagtcacccaactttgaagaaaaaagttgaaagctgatactgccaaatattaagacattattaaagtgacagtgattaacacagatggtgtaaacagaagagcagcagcacagaatattgaatccagacagaccacacatctgcagtctcttgatttatttattgatttatttatttatttttgaggcggagtctcgctgtgtcacccaggctggagtgcaatggtgctatctcggctcactgcaagcgccgcctcccgggttcacgccattctcctgccttagcctcccgcatagctgggactacaggcgcccgccaccacgccctgctgattttttttgtatttttagtagagacggggtttcaccgtgttagcctggatggtctcgatctcctgacctcatgatccgccctcctcagcctcccaaagtgctaggattataggcgtgagccaccgcgcccggccattgcagtctcttgatttatttcttaagtgatactgtagcacagagggggatggacgtcctcagtaagaggagtggatgtgattggctgtctgtgtgggaaattatgaatgctgatacctgcctcacaccatatacaaaagttaattccaaatagatcacaggtgtaaatgtgaactctaaagtaatatagtctctattctcgacaaacataggaaaatgcctatttcagagtaagaaaagatttcttacgcaaggtttaaaaagcagttatcaaaaaagcaattatcagaaaggaaaaggtcagtaaattgggctacattaaagttaagttactcttttcatcaaaatgaaccatgaagagatcgacacggaaagccacagtgtggaagcagatgtttgcaatatgcacatccaataagaaacttgtttctagcctatacagagaactacacaccaacaagttaaaggagaatctagtagaaaaacaaccaaaagatgtgaacaggcatatcataaaagaggatagccactagacacagaaggcttcctgcctctgggaaatgccaattaaagccatatcaggacgccactctgtatccacaagagtggctaaaattctactgacagacagtatccagtgctgacaaaaccatggagcaaccagaagtcacgtgcatttctggcaggtgtacatttgtccacatctacataattacagcaattcctaagaatatgtccaacaggagtgtgtattgtgtgcactagaagacatgtataagaagctcattgtcttatgttcagtttagccccaaactggaaacaacccaaatgtccattaagagtagaatttattaataaatcatatttcatcatatatgtataccataacccagcaacaagaatgaacagacaccctactgcaacaacatgggtgaatcccacaatgttgaaagaagccagacagcaaaaaagcacatattgtatatttttatttggacaaaattcaacggcaggcaaaactaatgtatggtgacaagagtcgggatggggcaccctggacggtgggaacggcctctcagtctgggcactcgctgccgtcactcacactctgtgcttctgcatgatgtgcattataattggacaaagtattcacataaagaatggtgtcctccaaggaaaagaacttaggtgccacctactctatcccagatgggccaaggtaaccgagtcgcactgtgcagggagggccttcctgtgtgtgtgtgtgtgtgtgtgtgtttcttttcctgaggacacagccaccctgctgtgcagggacccttctcccagactcctcttctcatcttgggtgcaggttgacgtttgagaagcaaagacaccaagggtccccttcctcccacccaggcctcacgtcccctcagcgcctcctggccacgcactgttgattcctaaggtctgctgccctctgcaagcactgctcctcccgtgtcctggcctccacctgcccctgccctgggacaaagcatcctcctcgcccccaccatgtccacgcagcagaggcagatgtccaggcactgggggaacgtggtgctggggcctccccgccccactggtagagaggagccagcctctgcttgcagaccatccctcacgctctgctcctgtccagtgagctgtggttgcacccgcaggccagtgggctgtctgcccacatgggtgggggaccatggggctcccaaggtcacgagccctgagtggtttgggtctctgtcacagaagacgcagccagttggaacattcctgaaactttatgagaccgctgggccttttttacttatttgggccaaaagtgagctcattggcctcaaactcagctgctgggaaactggccagggcagcccctccaaggccaactgttgcggagttggcagctgatggggcatctatgggctgtgtttgtgccctgggtgcgagggacatttctggggtggctgccagcttgagttattctaccccaactcctccggcaccatcaccttcatccctctggtgactctggggactgcttcctgctgaaactgggcagaagccacaccaccctctccctcagacacaggccacagatgtgggcatagatccgagctccgtgagccctgggtcctcactcctgtgagcagatccaggtcctgcctcacggttttgggcagtgcagcctcgggaatgccatgggccgtgggggggcggggaatcacgtggccctgccctcatgaccacagtcagtatgggggatcatgtggccctgcccccgtgaccacagtcagtatgggggatcacgtggccctgcccccatgaccacagtcagtatgggggatcacgtggccctgcccccatgaccacagtcagtatgggggatcatgtggccctgcccccatgaccacagtcagtatgggtagaggaggtgctaggggctctttacatcctcacgtcagaggcttttttagtccaggctttgcaccttctgagtcagtgttcccgaaatgtggtaggagaggagacatggggctgagggggtgtggacgagtgtccacctgggccctgcatagggggcaaggtcgtggtgggggctgcgcagggcaggaggctgagtgctggtgtgtgggcatctggggtcaggtccctgcttggtgggaacattaggaggccgccagggtggacgtggccttaggggcagcacacgtggtgtctgagccaggttcccctgtccgtgctcacagctatgtgactttgggcaagtgactaaagctctctgtgcctggagaggatcatagcaccagcctcacgggatggtcgctggagcttgatgaatagctgtagggctgttggcacagtgcctggtccatagcacagctgaggatagtctctaaccctgaagaagcatgcctcctgcctgcaccccgttcccacacatgccctgtgcccgcaccccgttcccacgcgcaccctgggcccgcaccccattcccacgcgtgccccatgcccgcacccacgatggtgagcatggctggggcaggaggaaccagcgctgccttcctgcccaggacccacaccttctgcagctgagcgacagtgactgccccattaacaccacctggaaaccagtccgtccttctcgttgagaaactgatttcctagtatgcattttttgaatcgaataaatttatgacaccttagatttcacttgcaattttgacttctaaaaaatgttttagtcgttggtaactggtttctcattgaaaacggatgcctatttgtgatactggtgttcccattacaatgtaacacaaagatttaaacgtagagtgagtggaagccccacacaggcaggccgggcggcatccagtggcatcgggcgcctttttcgtggctgcagcgtcagcctgcactgccgggtgtgaggcagacgcgcacttaacggcgtgagaagccagatgtgggaggcaccgggcactgtgggcagtgaggcaggagcttggccgcgtgtggggcagaagctccatggctagaatgggatgtgtttgggtcacgggtctgggggagggtgcgttctggctataactggatgtgtttgggccacagaggtctggggggtgcattctgcatccagcagctctcacatggcagtcgtggtccccgttgctggtctgggctgttgtggagtagcgggggcatttgtgggcgaacccagaggctgaaattccaccccaatcagagctctattccagggaaaaggggagaaattgagtcaggctttgttgttctgcaaaacagtgacgccgctcaggcagcgctgcgggttacagcatactcagtggcttcatttcactctcacggtaaccgctgggggtggattctacgattgtcctcatttttacagaaaaggaagcagagatggttcacagccaagtcacctgtccagggtgatgcctttgcggggcccaccagagcccgccagtgtcgcagaggcggtgagcccctcccgcccaacacacagccccttggcaggggctcttgagcaaacctgcaggtgggcagcttggggcgtttctcagctagcatcacccctgcttcaggacttgaaagcatttgactgggttcgctggcctgaggattacgtgctcggtggaaattagtcattctgggctcttctctccttcactctaggaggactgggacccagagagctccgggatcagctccctggcttggagtccaaaggcagctctgaccacgccgcctggggcaagagggagggcagctgggttccatctccgtggcctggcacatccaaggtccctttgtggaaaaggcacgtgtagcacctgttactggaggataacctgtaactttgtgcctctcccaagggagcacacaggtctacacgggaagtaagattccctgtacccactgtgtctcacagttcagaaaaagtcgtcaaagtgctcagactcaagaagtaaataaggaaatatgaaaacatgactttatttctttctttttttgagacagtctcgctctgttgcccaggctggagtgcagtggcaccatcacagctcactgcaacctcaaactcctgggccaagcaatcttcccacctcagactccccagtagctgggaccacaggcatgcgccaccacactcagctaatctttgtatttttcatagagacagggtctcatcatgttacccaggctgatctcgaactcctgggctccagtaatccacccaccttagcctcccaaagtgctgggattgcaggcgtgaaccaccacgcccagctgaaaatataactttaaaaaaaatcttagctccgtaagaactaagccagatcagaaaacgaattctgtctgtggcccccacagctgtgaaatggagtcgctgactcgccatgctcgtgcacgtgcttagtgcccactgcagaaggctgctttgaatgaaagctagtgtttattcgtgtactcacccagaaggtttctgctgttattgaatcaaattaccctacatgtgaggcatttttcacggccagatgcagacagggacacagacgcagcagcacccaccacacatgaacgttcgggggtcactgcctcgtcttcatgtcttgggagttgctgtttctgtctttaaatccgagcgtcagaaggatctgagacacccgatataaatccctggcttgttaatgatgctcacagagagcggccacgcccatagactgcataatttatctccatcctgcagaattctgattttcatgtaaacctaggacatgttcagagacttggaagttagcgattctagcccctgccttaggcatgcccgtgtggttgtttctgctttggattggctggtggtagcagctgctggcatcacgcaattggcttggctgcagagtgagcccacggaagagggctctccgcaccgactctgtgactcaggcttctactaccaggctcatccgaggacggaggctgtcgttatacaacgcgcaagtgtggtctctgtcacagatgtggctgtcgcagagagtgctgcctcctctcccgtttccagcagatgcttgggaaccttcagaagtcttggggattttctcccagcaccgtagccatgccaccacgagtgaatccttaacgtggaccagcacgggcacctcagatgccaggaccggcgtgatgtatgcgccataagactgttttggagggtttagtcagctggtcacccaggaaaggaaaatgactcggctcttactgtggaatagcaaatgactgagctcgggagagatggttctgcctcaatctgtgactcgaggtggttggtgttaggctgagaaataagaacacaccaaaagtgcctgcccttccgtagatgagagcaggttctgggactgcggggatggggctgccggggcccccgtgtgccatgcctctcacctggtattgcagaaatggcatcatgaatatgggggatcgctctcccaagaggttttctgagggatttcgtgggcagccggcttcccacctgcacacattaacggcggcgtctcttcctcactgcagcctgcaggacgctggcatcggattcatcctggtgatagaccggcgacgggacaaatggacctccgtgaaggcgtccgtcctgcgcatcgcagtaagtgccacccggggctctgccctgcgcccggcccctccctgggctgcatgaccgcatggtgcccttcctctgtgtctgccgcagttcctgctttgtgctgagtgggacagagcccagtcccggcgggtggaggccggcgccaaggccccccctgcttgggctcccaaggcactggtgcctgggtgtgagttttcccagatgaaggaactcttagggagcccaatgtgacttgcaaacaatttccccaggcagagcagcccatatgtttccgaacaccaagtctgagatgctcgggactgaatatgcctcttacatatttatacattagtgattttctcctttccaaatcgggccatctatctttagctgtgacactgaacgagccaccaccgcctcccttccccagtgggattgaacatgcacttcctcttacacaaagcacaacagtcctgaccaggcaggacgggggctgtgtgcagagacgctccaggctggaagttggaagtggtactgcacagctttcctatgtgattttctcctttccaaatcaggccatctagctgcgacactgaactagccaccaccgcctcccttccccagtaacccagcctcgcatgtagccaccctcctttccaaggactttcccttggcatccgagagtctgtttgcagattctgcacgctgccttccatagcagaaggggagctgggtttgctgttggttttaacccagagtaatcatttaagagggaagagattaagtcagcagaagcccccaaatcttatttttgtcggtagctcccacccgtatgcatgaccccggcatggagcatttttcacccacgctcgctctccccgcctgtccgtccaaatttcattgctgccaaaggaccaaaaaaggctgcctgtctgccaagaggtgacccagagcctgggtccaggcacctgcatgttctcacgcccgccacagcccgtccctcccaggctctgggaccctgggtcctcagctgtgatggcacaattgctccaagcattccccagcaccaaaccccagtgaagtcagattctcccagtgaagtcagattctcctggcctttcctgggtcccgcgttcagactacctttgggttccccagcctctcggtggctgctggctggtgcgccaaggtttgaggtatactgaaaaaagtcattcctttccccgcacattgcctcattccttcatcttttacaagaattagaggccccatatctgctccgatgcccacaaccttcatcgttttggtgcaagcctgtccctgagccgctggttctcatcgaagtctttaggatgaggcatctccttgcacccccacggcacctctctgcccctcgccgcggcggatccccgttcctgaccctgactcaacctggcacacaccacctatggcatcgttatctgaaataattcaaaacgcttcaggatgcttccaaaaaagtagacgtgtatagaatcggtcttcctttgttttaacagtgcgttcgtttgcttttgcgtcactataaagacgtacttgagctgggtaattgataaagaaagaggcgtaattggctcacagttctgcaggctgcacaggcttagcacctgcatcttctcagcttctgagggggcctcagggagctgccagtcgtggtggaaggcagcggggagccggcatcacatggtgagagagggagcgagagagaagggggaggtcccagacttttgaacagccagatctccagtgaacttactgagcgagaactcacccgtcaccaaggggatggcgctgagccattcataaggggtcacgcccagacttaatcacctcccaccaggccccacctcagcactgggaatcgcatttcaacatgagacttggaggggacaaaaatcccatccatatcaagcatccccagaaatgcagaaagttctttagataaaagccatcaccagctaacagccatgtgtgcctttcattattgtacgtcttaaatgagtttgcacatgaagtcataggcaactctaaaaattaaatcataagaacccacggggtcagacacacatggacggacaacagatactcttgggaagcacccatccgtcctgggcgggtcccacaatgctcccagcaggcacgtcgtcgtttaaacaacagacaacaccgttacagccgcatcttttatgcttacctgccgctgatataaaccagccatcaggacgactcttagcaacacgtgggtgtaggagtcggcctccctgccagggcacttgcggtgtcaggacgcacctgggtgcctttcatgcccgtggggtccaggcacctgcatcttcacacacctgccacagcccgtccctcacacggctcatgcctcactacatgtgccccgtcccctctgctcacgcctcgctacgtgtgccccgtcccctctgctcacacctcgctacgcgtgccctgtcccctctgctcacgcctcactacgcgtgccccagagcctccgctgatgcctcgctacgcgtgccccggcccctccgctgacgcctcgctacgcgtgccccagtgccctcgcacacacatcaccacgtgtgtgtctcagattaatcagtcactcccgggttagatgacaagagcttccccagatacgaggttactttttaagaaatacaaaaatcattttctaaaagcaaagtatttctgcgaggtcaccctacaggatagcgaagcagcccacagcagacccgtgatttaggtgtcgatcttcagctgccgagtgtcctgttccgttcaccgagtgtgtgatcggatgaatttcttaagcaggttggctcatcttgaaagctctgtcttgtgagcatcataactgaacagttagtgttttagtttttatttttgcattgattcttacaccataaaaatatggctttttctgtccttcctttaattctcagaattgaccaacattggtttggaagtaacagaagccagcattttccagcaaaatcacccagaattctctctgaacaccagtgctttcttgctataataatttacggtctttttttttttttttttttttgagacggagtctcattctttcgcccaggccggactgcagtggcgcgatctcagctcactgcaagctctgcctccccgggttcacgccattctcctgcctcagcctcccaagtagctgggactacaggcacctgccaccacgcccggctaattttttatatttttagtagagacggggtttcacccacgttagccaggatggtctcaatctcctgacctcgtgatccgcctgcctcggcctcccaaagtgctgggattacaggtgtgagccaccgcgcccggcttatggtcatattaatacacagactctgtgtagttagcacgtcctgaggcttttctctgtcccaggcactgcctgggcatcacggatgtgagggaggaagtgagcaaggctcaccgccagctgggtgaggacagttgaggggcatcacaatggggtcacaggcaggggcagcagggagcagccaggagggtggctgagccatggggagggggcagagttaggccccacatgccaggccccatccacctgggctgtgaccctggagagggcgtcttcctgtccccaggcccctgctacccaggagcccgccgcctccagaagggtttggtgcaggaggggcatgagaaaccggcaggagatgatgatggtggacattggatgggccaggagacatggagctcacagccctggtttcatgaaggagaagtgggccacaaggccaaggaggcaggaggcgggcagtggtggcactgtcataggagctggttgtgcatgtgctgaggcttagagggtcactggtcaagggagtgagggcagctgtggacccagccaagcctaggtcctgggcagaccaggaggggtgagggtctctgcagtggggaaggggtgggtggtggggctggcggggaggccccaggctctgtccatgagccacgcactccttggagagggcagaccagggatgaccccttgggcatcttgattcagttttttggaaatggtgcagttgacctgacgtggggacaccaagtagtggctgcagcggggcacctggacgccaacccctgggctccaggccttgacagcgagctttggctggcctaggcttccacctaaagtggctttgggaaaactagcacttagcaacagtccaggccagccgagccctcaagcaggtttccaaacaggcacaggctccagctgcccgaccccaccagggtgcccagctcatggtgctgcgggcgccacaaagcaagcccgtggcagagacttgcctccaagcgctcggccaccgaggaggacgcagcgcttacataatgtgccgggatccggggctatttttagccaccatatgtgctgtcttaagagctgagctctccctaatttggggtgttcttttttcttttctggatgccttcagcatggcttggaatagaaaaattagacattggaagagccaaaatccagtgttcctaaaaccaggctcccaatcgagagcaagacccatgtgatgctgagggcgtgtgggagaaggataggttcacagctacccacccagggggcagaaagatgagatcctctgagaactcacgtctcttctcccttaggcagttgtgcggtcctcagatagaagcatcttttataaaatgctgttgcaacatctaaccctcttccactgtactgcatgtgtgagtgtgtgagtgtgagtgtgtgactgtgtgtgtgtgcgagcgagtgggagtgtaagtgaatgtgagactgtgtgagtgtgtgagtgtgtgcgcgagtgggagtgtaagtgaatgtgtgtgagactgtgagtgtgagagtgtgtgtgtgtgagagtgagtgtgtgtgtgcgtgttcacattttgggaatttgtaatagagtatatatattcatgtttagagctagcctaaatcaaactaaatctagatcctcaagtaggtggctggagaaagtgaatctgatttttagactgcatggggccacaactctctttcctgtaacgccggtgcagtctgtgtgtgcaggaaaggtagaaaacaaggtgtctgagggaccccggacttctaggtcgtccagcaaatctttcacatttgcaaagtacgattgtatgcggcccccctgtgccagctactggggctctggggaggagctcaccgtgggggcggtgggggcggtgggagccgtgggggccggggcggtggaggggggggtggctgggggagcggggaggcgggaggagcagggggggcgggggcggggggggcggggggagcgggggggtgcggggggcggtggcggggggaggggggcggcagggggcggtgggagcggtgctaactccaggaggacttcccggcggaggtgatgcttggtgagagcctgacgggaggaggagttgtccagatggaggggggcgaggagcttcccctgggaacacaaagcagctggctgccgagggagagagggccaggtccgtgtgcccctctcggaagaggcgagaccgtcccccagggcagggaactgaaatgcgcgctgcataactgcggcgacacgggggtgggggacccagctcttcccggtgtggctgagctttctcagaacaccgctgctgtgtgcagcaagcacctgcccaggtgagcacagtccccccgtggtggacagaaggggaccaggatctgcaggctgtctcctccgcaccagctgctgtggcaaatgcgtttcagcgcaccctgcgcgttcaccaaccgccgattacaggggaggagctgggcttcggggcgacgagggaagctgccgatggggtggggcggctctgggggcggcctgggcctttctgtctctgaagcccgagctctctccctactccggtggtcccagggccacggcggtgggcggtgccggtcatgcagaatattgcagggggaggcagcccgtgaggcttccacgacgctgagagcgtctatttaaacgactgtccttcatccgagggttcgctcctcccacctaagggtggatttgacagccttggggtatccagcaggggtgggagatccagaggccccaagcccttcttcactgtgtatttcctggaacatggaatccaagggtccaataacgggcggcacgagccactttgctctctctaaagacctcggaggcgacacagtgaataacaaggttgtcttagtccgggtctgctgcttatatgtcaagagtatctgaaactgggcactttacaacgaaaaagaattcatgccttacagttgaggagcctcacctggtgagatccctcttgctggtgggtcctgaggcgacgcgggacctcacctggcgaggggagagtgagccagcccagggctgcccccgctgcttacaaagccaccaggcccccacccacccccacgacagcccgttaatccgagaatccgtgaatggatgaatccattcatgagggtggggccgtcctgacccagtcacctctgaaaggtactgcctctcaatgctgccatgagtttcgaagtttggtagggacgaacattccaaccacaccaaatgtatatttcagaattgctaaaagaatccattttaaatgttctcagcacagaaaactggtgagtgggtgaggtgacagatcggttaattggcttgatttaatcattccactgaggatacctatagcaaaacatcactgggtgccccgtaagtagatacaatcatgatttgtcagttaaatgtagaaacatttttttaaaaagataaacagagaaaaagaaagagctctgagacccgggctcgctcagcggttttttctcgcagagaagaggaaggagcccgggggtccctgggaccaggtgcctcatgaggctccgtgtgggccgtggaccctgcaggccacgccggcttccctgactgataaacccagagccaggccttgccggtgagaggccagggactgctggctgagcttctccagcgctgctcttcactcccctggatgcctggagcgagactatttgcctggtttatttttttcagcttagagctcgttgcacggagtcagaacccctgcatcccggtggctcaggcatttgagtgaaggtcggatcaggagggaggggagatgcagctgccccacgcatggaggagaagagctgtgagctgcagcagcctcgtgtctttttcctctcaactttcagttcagaaaaatttcagacctacagaaaacttgggagagtctcacagtgaacaaacctcagctgtggccataaacaaagtgcccattcgtgtgtgtgtgtgtgcgtgtgtacaaaaacacacagacatagacacagacatgtacacacatcacacagacacatcacacagacacaaaacacatcacatagacacatacacagacacacacatatatatacacatatacccacacatacatcacataaacacacacacatatcacacagacatgcatacactcagagacatacatcacacaggcacagagacacacatcacacacaaacacacacatatatgcacatatacacacatcacataaacacagacacacacacacattttgctggtgagagccggctctgccatcgtgtcagttcatcccggattgctgacatggtgtctcctgagtggagctgccctctgcataaccacaggcgagtctgcatcgcggccacactgccctctggatgcccacacatggggctttctccacgtgccccgtcatgtccttcctgtatttgttaaaatccaggtccagtgaaggacggcgcccccgtcagctgtccacccttctcagtcgtctctaatccacccagttgttggtttttgttttgctttctgtcttttgtgagattgagatttgcgaagggttgaagccagttgctttatggaatatcctttcatctggtttccttgtaattaggttccacgtggtcctttggggcgggaatcctggtgggtgagcttctggggcagcccgtggaggcccaggatgtccatgtgtcccgtgattggggcggtgttgtgtgctcagacggccaaggaggcgtccggatttccccaggagaaggtgcctctcctcttggtaatcagtgggtcatgtgtggtgatgctcaggacggggcgaaggtcccgtggctgaggtgtccactgaccgtttctgcctgaatgggtggttcggtggtggttgccacagggctgtgttttcaaggggagcagcaggtgcctggcgtctgcatccacacctgcctggagcctccttccatttgttactctgtctcctcctgtgtccctgcagctgtgtctccagtgatcttgcctgtactctccgcctctgcagagtgaggttttcactgattgcaaagtaaacatgcacgccccttcagggtcctggtccttagggagctggttaacaagttgaccagaaaaacaacccgaatactcctcaactcttgatgggagctcagttcacacggctccgaatcggcgaaacgcaaccaacgctgggcagaaccttggcacaactttgctggtgtctgctgagaagccgaggggaggttctggggcttggcttgagctgcggggtgagtgtgggagagacggcgagctccctcccatcaatcaatcaacagactgtcctattttcatagtagtccccacccaaatgtcattcgagtccaatctcaggatcctggatgcacgcctgttctccaggtctgcttcccgtgaaattcgtggagattattgtacattcgggagtgggagtgcgattggatgtgtgtctgcagattctccctgtattttctcccaggctttctagaggaccatttgctagaggaccagtccccaaacggccgcgcttttaggattggttttaggagtgatggcctcacgcacacggcagcggccattctgagcactcgtgtctgaacatctgcaggaacagggtccacgcccattgttttcctcacccggtccagcgtctctgattccggctctaacgtcttcttcatctgttaacacagagacacaaacaaactttcaaatgcatattttttatataaacttgtgtttactgtttggctactgtcagacaaatgtagttggtgaggtttcagttgctctgaaattaaatatataatgtcaagctggataggtgtggcttggagcagaccttaaggaaggtgatttgaacttggggagggtttttcaaacagggttccccaaagtacccagttctacaaagttcccagcatgtcctgttgctttagctgcattggtaaatacatgcagcgattgttttctgagtctctaagaatattaactcagaaaccagtgaactctttttctatctccagactacagtgctgtggtcatcacacatatctgttcctaagttcatccaggtcagcccagaaaatgagcaatattgttttcatgttagatagaaacctataggattactttactgttgagtaatttacaaaaagacttgacagcctccatcccaaattcttcatccagttaccatttatacttacccccatcttttaaaataaagtttttattttagaactttccccagcttttaatacaaacggtcaactccaattcagagaaaattttatttgctgttatatttattcaaagtatgtgtttgtgtacatcgttagcaccttctcactcagctaggatcttccaatttattctatttaatataatgatccaataacttaaaatacgaaaccctaaaactgagccaaggaagagggggtcatgtttgatgctggcagagcctcagggaccagccttgctgcaggggtatgcttcactcccagaggctttaggggcaaatagttgcacctgctggagacgtggacccccccccccgccacacacacacacacacacacacacacacacacacacacacacacacacacacacacacacacctggcttcatctctgagcttcaggctctcagcttgtccttaaagatccaggtgataaaaacgacagtgaaacgtagaagagcgtgattcatcgcaccatcagaaaaagactggttttccgtaaatagtggtgtccaatttcacagcagtgtgagggattttcagtccgccccttgctgagacacagaatctgccctggggcgtcccactctttggggcttgcttctcgaaggaggactgcccaggcgcctcgtccaccaggatcacactcctggcagatgctcagctcacgattccctgcttgtaattcagcctgtccgtcacagcatcttacccacacgtgctccctgcagaaggtgaatggctgtggccttagtctatgtccaggcgtcgtgtgagatggtggggcagagagggcgcagatgcagggcccctccagagcacttccctgggggccgaggctggagagaatgggtgtggagagcagcggagacaggagagtcccccggaagccatcagcctcccctccctcatccactccgcagcagacacccgcagaggacctgccaagtgtgccggccactgagggccgtggtccctgccctccccacgcaatgcagatgaagcagaggtctccatgggaggggtcctgtgggaaaggtgtgcagtgtccacccagtgacaggacattgtccacctgccctggacggggagggcagccgcccagtgaccgagcccttagtttatgcacaaggggcaggggcacatctctggttttaattcctacaaggcaggtgacctggtccatgtttgggtgctgagtgtttgggtgctgtgtgtttgggtgctgagtgtttgggtgctgtgtgtttgggtgctgagtgtttcggtgctgtgtgggtgtggagtgtttgggtgctgagtgtttaggtgctgtgtgtttgggtgctgagtgttttggcactgagtgggtgctgtgtgtttgggtgctgagtgtttcggcgctgagtgggtgctgtgtgtttgggtgctgagtgtttgggtgctgagtgtttcggcgctgagtgggtgctgagtgggtgctgtgtgtttgggtgctgagtgggcactgagtgggcgctgagtgtttgcgtgctgtgtgtttgggtgctgagtgttttggcgctgagtgagtgctgagtgtttgggtgctgtgtgtttgggtgctgagtggttgggtgctgtgtgggtgcggagtgtttgggtgctgagtgtttaggtgctgtgtgtttgggtgctgagtgggtgctgagtgtttcggcgctgagtgggtgctgtgtgtttgggtgctgagtgttttggcactgagtgtttgggtgctgtgtgtttgggtgctgagtgtttaggtgctgtgtgtttgggtgctgagtgtttcggcgctgagtgggtgctgagtgggtgctgtgtgtttgggtgctgagtgggtgctgagtgtttcggcgctgagtgggtgctgagtgggtgctgtgtgtttgggtgctgagtgtttgggtgctgagtgtttcggcgctgagtgggtgctgtgtgtttgggtgctgagtgggcactgagtgggcgctgagtgtttgggtgctgtgtgtttgggtgctgagtgttttggtgctgagtgtttgggtgctgtgtgtttgggtgctgagtgcttgggtgctgtgtgtttgggtgctgagtgggtgctgaatgtttgggtgctgagtaggtgctgtgtgttttggtgctgagtgtttaggtgctgtgtgtttgggtactgagtgggtgctgtgtttaggtgctgtgtgtttgggtgctgagtgggtgctgtgtttgggtgctgtgggtgctgaatgggtgctgttttggcactgagtgggtgctgagtgggtgctgtgtgggcgctgagtgtttgggggctgtttgggcactgagtgtttgggtgctgagtgtttaggtgctgtgtgtttgggtgctgagtgttgggcactgagtgggtgctgagtgttttggcactgggtgctgagtgttgggtgctgagtgggcgctgagtgtttgggtgctgagtgtttgggtgctgagtgtttagtagctgcgtgtttgctgtgtgtttgggtgctgtgtgtttgagtggtgtgtgtttgggtgctgtgtgtttgagtgctgtgtgtttgggtgctgagtgtttgggtgctgagtgtttaggtgctgtgtgtttgggtgctgagtgttgggtgctgagtgtttgggtgctgagtgttttggcactgtttgggtgctgagtgttgggtgctgagtgggcactgagtgtttgggtgctgagtgtttagtagctgcgtgtttgctgtgtgtttgggtgctgagtgtttgggcactgtgtgggcgctgagtgtttgggcgctgtgtgtttgggcactgagtgtttggatgctgagtgtttgggtgctgagtgggtgctgtgtgtttgggtgctgagtgttgggtgctgagtgtttgggtgctgagtgttttggcactgtttgggtgctgagtgttgggtgctgagtgtttgggctctgagtgtttggacactgaatgggtgctgagtgtttaggtgctgagtgtttgggtgctgagtgtttcggtgctgtttgggtgctgagtgtttgggcgctgagtgtttgggtgctgagtgtttaggtgctgagtgggcgctgtgtgtttgggcgctgagtgtttaggcactgagtgggcactatgtgggcattgagtttttgggcgctgtgtgtttgggcgctgagtgtttgggtgctgagtgtgtgggcgctgagtgggcattgagtgggtgctgagtgtttgggcactgagtgggcgttgagtgttcgggcactttgtgtttgggtgctgagtgggtgctgtgtgtttggtcactgagtgggcgctaagtgggtgctgagtgttttggtgctgagtatttgggtgctgagtgggtgctgtgtgtttgagtgctgtgtgtttgggtgctgagtgggtgctgagtgcttaggtgctgtgtgtttgggtgctgagtggtgggagctgagtgtttggatgctgagtgttttggcgctgtgtgggtgctgagtgtttagtagctgtgtgtttgctgtgtggttgctgagtgtttgggtgctgagtgtttagttgctgtgtgtttgctgtgtgtttgggtgctgagtgtttgggcactgagtgggcgctgtgtgtttgggcgctgagtgggcactgaatgggcgctgtttgggcactgagtgggtgctgtgtgggcgctgagtgggcgctgtgtgtttgggggctgagtatttgggggctgagtggacactgtgtatttgggcactgagtgggcgctgtgtgtttgggcgctgagtgtttgggtgctgagtgtttgggtgatgtgtgggcgctgtgtatttgggcgctgagtgggcgctgagtgtttaggtgctgagtgtttgggtgctgagtgtttcggcactgtttgggtgctgagtgtttcagcgctgtttgggtgctgagtgtttcagtgccatttgggtgctgagtgggtgctgagtgtttgggtgctgaggacagacttgtcaaggtcttgctactaggattccacaactgtggaaaaggcattgtataatcctaagtgaggtcccagccacttatgttgcaatcccagagctgggttggaacttggggtgcgcgatctagaattcccgcctgagatcatgttgtcagcagtagagatgagcccaggtgtccctgcagccagcgtggctggagggcccagacttggcccacgccccacgcgtcccctgacttcagaccctaccccagcttcctaacctcagggccctcttcttatggtcctcgctaggccagcctgaacattggagtgtggctggggcagtgcccaggcaggacatcctggtgagtcggtcactcctcctctagtccttgctgctatattcctttcgggctttagggcaatgccattcttttctatatgtcatattttaggtgcatttaacttagttatccagaaatcaaactcagttgcttcagtttctttttttggtgatggggtctccctggatttcagcatctggacataacttggtgtcgagagcaaccatcactgcacgtctgtcatcgcggcttttgagcgcttccttggtgcaggtgtccactgaacgccacgcacgccttggtccatttcatcttcgaaagggtgtcatgagtaggcactgccggtctccccactttcccaatggagaagctgagacacagagaaggggagtgacctacccaagttcccacgccttgtaagaggcagagccagtttccaaataaattcatgtaactgtgtccaaggccgtgtgtgcacaccagggcacaagattatttttatttttgtaggtaacacacacatgtgtctatgttgcttttataaaatttgacaagtgtcttggtttcctggggccatggtaacaaagtaactacagactgaccactgggcgcacagaagctgttccctcccagccccggaggcggagtctgaactcaggtgtggccggagggggctccttccaaggctatggggagcgtctctctgctcgaggcctctcctcagcttctggtctggctgcctcctgggtctccctgggtgtggaagcaccgccccggcctccaccagcaaattctctgggagctctccacgcggtgctgggatcagggcctgccctaatgacctcactttagcttggttacctctgtaaagaccgcgtcaccagccaaggtcacgttcggaggcactgggagttaggcttcgacatcataatttggggggacacagctcagcccctaacaactgtcgtaagctttggacttttacatttgtaagcagcataacgttctgccaagacatgaggcttttcctcttttcttttagaaaagagatgcctttcacagaggccagcatctctaccatgtttatctcagcataaacctgctgcgttgaggatgcctggccgctagctgcgcgcccccggtcagcccagcgtgcaggcaccgcactaggggggctgctgtctgcagagcacgctgcaggcccttgtctctcgccctctctcacaggcatctttcccggcaaacctgcagctcgtcctcgtgcttcgcccgacgggttttttccaaaggactctctccgacatcgctttcaaattcaatagagatgactttaagatgaaggtgccggtaagtgcgccccgcctccatcctgcggtagcagaacggaactcattgccgtcctggcccatctgtgatcatcgaaatcctcgaggagctgacttcagggccacacggtcaacaaaaccccgcaggacctggcgggaagttgcacctcctcaatgctgccagaagcagtacaatcctttcttcccccacccccgcccccagcccccaccccgccagaggtgcacagagcatcaacctcagagaggccaccgtgtgggcatcccatcaggacgcgggtcacgcgacattcatacccccaggagaactacagaacttgagaccctaagggctgagagtccgcctggcccacccgcgaggaactcagcccaggccctgcctgcaccccagggatgagagaagggctggggagggggctgtaagcatctctggacctgggagggagcacccactgctgacagggatgggccggacctgtcctggagcagccaacagggtgacccctgccccatcgccaccacactatcccggcacagggcagcatctcccaacactgcccactgagaaagcaccttcagtcctgatctgctgtcctttaaagaacaaaggcttcacaaagtcccttagagcctgtggagcccggtcaccagcccgagctgtgtagctcccccggagagccctggtcagctgccttggcgagctcacatcttctctgccacaaagagaacagagacatatgggccagcaccaggcaccgcagagcaccccatggcaccagccagatgctactggaaaccaggcaatctggggtgcaggtcgctcactgtgaagctactccctgtgcgctgggaatcaggtggcaccagccctccctccccaccctcgttgcgctacagcctcaatgccaaaggtgcaagagcccttctctgacagggaagaaaacggcctggggcctttccccatgtactgcccccttcccctcccctcccctcccccttgccctcccctcccccttgccctcccctccctcttccctttcccctcccttccctctcccccttcccctcccctccctctcccccttcccctcccttccctctcccccttcccctcttttctctcccctccccctccctcctcctcccctcccctcttttccccctccccctcctcctccccttcctcctcctctccccctacccaagacagccctgggggtcacaaggccccatccactctgcccacccccacgcagtccactctgggtgtcacccgtgaccctggtgcctggcctggggcagtaactgcaggtgcagggtgttctgcatggcacccatggggctctgtgccatcgtgctttggtggccccagaaccaccagcttccaagccattgggaaactctgtgcatgtaccgttttttgtagccttggagaagccttagtgtctgaacagtccattccctagagacgaccagcgacaaaaccgtgcagagcagggactcgtgggcagtgggaggctcatgtcctgacaccaggatgagctaggcattgcgtgtgcagctcagagctcctctgacagctcctctcgtgatggcgtgtgcagctcagcaccctgcagacagcacctctcgtggtggcttgtgcagctcagcgccccgcagacagctactctcttggtggcttgtgtgtgttatggcccttatgatggagataactccgtgcgccctccttccctgctatttggcaggcactgcacactagccataggctttgtgaccacagacgtgtcacggggagcaagaccgacctcacgggtcatccatgccacaggctcccctgcacaacggctccacagcaagccgtcaaaatgggtttcacagaaatcaccggcatcttcaaactcacagccccacttagataattcttgaaattagagtggatgatgtgaaggatgcagttgttgacacgtgtgtgtccgtgtttcagtgccgtgtgctggactcagccatagaaaggagacatgagggagaacagtggccccggcacctctgctgccgtgactgactgtccaaacccatggatggagtgacctcaaaaagggcaagagaaatgcagaaaaatgaagacaaggcgtgtgtagaggagcttatgcggccgtcgcaaccacaggttttccacataaccataaccgtgtgggaactgccagccactctccccgtccggcctcagtggtggtgtgttgatttcaactggtgtctacaatgaccgcggggtattttcggcaggaacagggacaaaaatgatcatctctcccatcagagcactgtttgatgatgttgctggaggaggtgtaaacgcctgttgcatgtccttggccatcacaggccgcactcgtgtggagttttgtgcacctccaacagcaccatttgctgctcaccgtggcatgatgagctcaggcacaacgtgcccatttacgaaggaggcagctgagacacagagtgggcggctggcctgcgggcgagtgggacccacatctgggtccacacaggtccgaagccaggcgcccctgtccacacagccacccacaatgtccaggcgcccccatccgctcagctgcctacagtgtccagacacccctgcctgcacagccgcccacagcgttcaggcgtccctgtccacacagctgcccacggtgtccagacacccctgtccacacagccgcccacagcgttcaggcgtccctgtccacacagccgcccacagcgttcaggcgtccctgtccacacagctgcccacagcgttcaggcgcccctgtccacacagccacccacggtgtccagggtttggataaaatctaggcttggctttgcaagcagtcagacgggaccacaaaatgggtctcctgaggtttagctcaggggttatttgacaccacatcatgttttattaaataccgtatcagtctagagtggggactccactgggggtgattttgccagatagtcacggcagcagaggtgccggggccactgttctccctcatgtctcctttctacggctgagttcagcacacggcactgaaacacggacacacacgtgtcaacaactgcatccttcacatcatccactctaatttcaagaattatctaagtggggctgtgagtttgaagatgccggtgatttctgtgaaacccattttgacggcttgctgtggagccgttgtgcaggggagcctgtggcatggatgacccgtgaggtcggtcttgctccccgtgacacgtctgtggtcacaaagcctatggctagtgtgcagtgcctgccaaatagcagggaaggagggcgcacggagttatctccatcataagggccataacacacacacgccaccacgagaggaggtgtcggcggggcgctgagctgcatcccatccgcacatccatccgcagtgtccaggtgcccccacccacacagccgcccgcagcatccaggcagacgtggtcctctctgtgctgctgggtgttctgctgatggggcagctcttttgggagccaacaataatcccaaacactaccacgcattccctttctcctccaggtcataatgctgagctccgtaccagacttacacggttacatcgataagtcgcagctgaccgaggacctgggtgggaccctggactactgccactcccggtggctgtgccagcgcacggtgagccgcgtcggggccagcggggctggctgataccagctcgagtacttccacagaatcgctcttgcattacaacacggccctttccaaaaacacattcacattaacagtcgttttctttcccaagaatgaggagatggtctcagtggaccttagtcattgtaaagaagtaacgtgagtcataagtttgggagtggctttctctgggcttggagaccaaaaaaaaaaaaaaaacccttgcgttgtggtttgcaacactcactgctctcaacggggagaggcagcgcaggcacaggcgactctaggtgacgggcacacgtgtagagtgtgcctggtatgtttctgaagaggtcaaggagggcaggacgctatgggagggcgttcaccgtctttgcgtcagccggtctcacctgatgggtctgtgtgggaacggtttccgccggtgtctgctttcagggcagcaggaggtgggtgcagtgcacaaggcatgcaattgtgttttctctgtccccaaggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggtacatggggggtgctccggctggaagctgtggggggctccggtcagtcagaagctgcgcggggctccggtcggaagctgcggggggtctttcgtcccagcgggagtttgtgtcagcagcacgtaagaccaagaagtcagcaggcttgagatgccttttgatggcaattagctcggcaacctctccgacgagaacggaataaaaggagtgtaaatgaaccctgtagattgctggctgcgcctgccattctggcgttgggtcaaccattggccctgggtggccgtggcttcaggagtgggaccaggggtggctcctctcaggagcacttttggctgtctgtgcggggagctcccgaatagacatctcttgcttctgagtgtgaccgagacaggatgtctgtgccggtttctcatgccgagcaggcgatgaagtggcggttggaattcctgtttgcagaacactcccagtgctcacgtgtccacagcgcttgctggaacaaacgtattctgaggagcacgtgctccctgctctgtgctgcccctggcccaccggcacgctgctggctttgcagcaatggtagcccagggccatgacctgctggtgtgtccccgaggactgtgcctctgtgctcaccgggccgctccaccgtgaggacactgaggaccaggagcaggcaccatgagaaagcctggtctccagtgactctttcaccttaacccgttgccctgagtgccctgtaatggcagctctgccccggggcacacaggagtgagggaggcccccacatcaccccgcctgcccgcacgaccccacagaagagactgggaagactcgggggtcggggattgaccccttcctcagtccccgccccctcaagagcaaggccccacgaggcctcaccaccagcctgcgctgtgtgcctggacggggccgggacatgaggctgcattctctccacaggaggatttgaggctggcactgaaagaggggcacagtgtcctggagagcctcagggagctgcaggctgagggctcagagcccagtgtgaaccaggaccagcttgacaaccaggccaccgtgcagaggtgaggcccggctgccttcctgccctcatcctgtcccagtccatggcaggatcctctcaggcacacagcttctgcaaaagaaacaggccacggaaatagcaagcagcgtggcaggcaaccccactcctggccagggccagcacagcagccggcctccgagcctctgtgtgggcctggctcctcctgctgaaatgcttttctctcgaaccccacagaaagccactgttttggggacaatttcctagagcaaacgcccttttgccggcatgaaggaggcgttaggggaagcagaggcgatgggagtgccttagacctggggcttctgcattccaagcggggcttccacagacagggagaaagcctggggttctccttgctgcagatagtgtttcttactttcattgtgaaaggtgtgattctcatatttctcccttgggcttccagctttatagcagcacagggtagggcactcgtgtggttggcatggtgctctaggatgtccagaactccctgagcatccccctcaccccccgagaactccccgagcctccccccgtcccatcctccccaagactccccaagcctcccatgtcccatctcgctggtgggtgctatcagccctgcctccgagctgaggagcagggcccgcacagctggacagcggcttgtccggcagggccgtgcggggcgcacccaggcctggaccaagctggtccttttgactctcagctgcctttgactcccacgcagcgtggcccacaccctgagctgccttctctgccagggacatgccaagggccccggggactcgacggcgcatccttgaggggctcctcgtagatggggtgccgtgacccacgaggcagaggctgcagcacagcccatgagggtgggccctgccctggcctgtgtcaggcaccttgtcagcttcccaaagactcagtttcctcatctgtaaagtgacgctgatccgtgcacacgcctggcagggtgggcgtggggctgactgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggcgcacagctggagtgccagctactcggaggcagaggtcgcagtgagccgagattgcacctgggtggcgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtcccagctacgcagaggcagaggtcgcagtgagccgagattgcacctgggtggtgcacagctggagtgccagctacgcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgtggaggcagaggtcgcagtgagccgagattgcacctgggtggtgcacagctggagtcccagctacgcggaggcagaggttgcagtgagccgagactgcaccactgcacccagcccaggtgatggaaccagaccctatctcaaaaaataaattttaaaaaaagtttttaaacttttaaaaaataaaaatgaacaaactcggcggctcagcctagtcgcagtgacctagagggagagaagcaggaaggaaaggacacagcccctgatgctttctccagggcctccctcccatgctgacggccctgagtgcccgcgcccgcagatcccaggtttaggtgcagggagtgagcggaggccaggatctcaggaaggcccggggtggagatgagccttggggtcgcttgaacacccaccgcgctccacgttgcatggggcgccgtgggccacacagacggtcaactcctcctctttcccaggctcctggcccagctgaacgaaaccgaggctgccttcgatgagttctgggcaaagcatcagcagaaactggagcagtgtctgcagctccggcactttgagcagggcttccgggaggtgagtggccctgggtggagccggcagccgccctgatgctcacggggcctcctgtgcctgcgccctggtcccagtgccgggagctgagccgtgccacccagttgactttggcttaatgcagaaaagtctccgcttgccaggtggagcctgtgagattaagtcaggctgagccttgaaatgcacgattgatgactgcgtcattgtatagaaaggtgattgaaaatcagctcactgggatgcacttacactgcattattcgtaaagtagcaggaagcctttgctctcccttcatagtcatttgcatgcccttttattcaacatgcatgtaggatgtgcctgctgtgtgccagactgtaggacggcgtcacagtcatgaggtgcacagcgacacggccagtgcagccagacccagacgtctccctcctgcggcccttcgtggactcacccatgtccctcctcagcccccggcaaccactcatctgtttccgtggctgtgcttttgccatttcaagaatgtgacattaatgaatcccacagaatgtcactctcgggatttgtttgtttgctcagcacagctctctgcagacccccaggtgccggtggctcactcattgtgttccccggtgtggacggaccacagttctttcaatcattcacctgttgaagggtatctgggttgtttccggatttgagtattacagataaagctgttacaaacattgatatactgatgttggtgtaaatgtaagttttcatttcttgggcttaagtgcccagaatgtaattgcagggttatatagtagttgcatgtttcgtttaagaaaatgccaaacggttctcagtgtatgagagactagttgcttcccctttccccagcacgtggtggggtagtgattcttcatattatgctcacatcctgatgtgtgtgccatctcacggtggttttctgttgcgtttccccagtgttgatggtgctaaacacctttccacgtgcttatttgccattcgcatatcctctttggtaaaatgtcttatttctgttgcccattttctaactggattgtttggttttgtgcttttgttttacggttttgttacattttgagaattccttatatactgcagatactagttctttgccacatatgtggtttgcgaatattttctcctggtctgtaacttgtcttttcatcctctttaacagggtttttcacgtagccaaagcatttaattttgacgaactccaatttgtcaatttctccttttaaggtttatacttttggtcctagattccaagtatattcccctaagcctttttcccctcaaatttcatagttttacattgaagtctatgacctaatttgagctaatttttgtataaggtatgagaattagatcatgatttgttttacctctggatgtccaattgctgtagcactgtttgttgaaaaggccctttcttccactggatttcttctccaccgttgtcaaagctctgggcacatttgtgtgggtctgttctggagactctctattcaattatgtttatctacatacctcttcctctgtctgtaccacaaggtcttaattgctgcaactatataatgtcttgaaatcaagtacactcattcttccctctttgttttctttttcaaaattgtgttagcttctagttcttttgccttttcatggcaattttaaaattatcttgtctacatatatgaaaacaaatttcctggggttttcataggagttgtgttaaacctatattttaaggagaagaaatgtctttactgtgttgactcttctagtcaacaaacatggtattcccaacatttgatttctttcatcagtgtcgagtagttctcagcacacaagttcagtacgtattttgtttgacttacctttaatattccactttaagaagtcatcacagtattatatttttaattttggcatttatgtattcattgctgcacatagaaacacaattgatttttgtatatttatcttgtctcctgcgaccttgctgagcacacgtatttgagatggttttttgtgaagtccttgacattttccatatagaccatcatgtcatgtgcaaataaggacagtttggtttcttcctttttgaagatatgccttttattctaccccccacccacaacaccctgccccactgcgtactgccccaactagagcttccaccatatgataagagtggcgagactggacatctctgctttgtccccaaccttaggaggaaagtgtttagtttttcactgtcaggtgtaatgttagttgtaggattcttgtagatgctcaataaaactatctgggcctagagatttctttgggagacttttaaaattatgaattcagtgtccttaatagttacgcaactattgaaactatctgtttcacaatgagatatagtagtgtgcttttcaaggcaatgtgtagggttgtttatagtattctttcttatctttttgacgtctgcagggtctgtagtgatattccctgtttcatttctgatatttgtaatttgcatcttttccttttttctttgtcaatctagattgagatgtatcactcctcatctttccaaagaactcgttctttgtttcattagttttctctgttgttttctgttctcagtttcattgatttctgatcctacctttattatttctacaaattgctttggtgggaacttacattctttatttgagactgttcctcttttctaacatacatatttaataagaacactataaatttccctctcatcactgatttagctgtgttccacaaattttgatgtattgtattttctttttcatttactccagctttttttttttttttttccaatttcccttggaacttcctctttgacccatccattctttaaatgtatgttgtttggcttccagtgttcagagattttcccgttgtctttccattcttgatttcaagtttgattcattgtaatcagagaacatactctgtatgatttctgttcttataaatgtgttgagatttgttttgcagcccaagaatatggtctttcttggtatatgttcctcacttgaaaagaatgtgtattctgctattgttaggtgaagttttatacatatcagttagatcctgttggttgatggtattgagttcttctatatccgagctagtttctgagaggtggtgcattatccataactcagtggctgtgcgtaacatggagagaagtctcactcatcagctgtgccagatgcagggggttcaaggatggacaagaatcctgccttcctggccttcaaccccaggccatctgaactacaacccccttggcactgggatgtctgcgtacacacccattctcaggatcatttccaataacaaaaattaaaagcttttgtatttaaaggaataagtggtcatatgttttaaaaatcaggccaggcatggtggctcacacctgtaatcccagcactgtgggaggccaagacgggtggatcacctgtggtcaggagttcaagaccaacctggccaacatggtgaaaccccatctctactaaaaatgcaaaaattagctgggcgtgatggctggtgcctgtaatcccagctacttgggaggctgaggcaggaaaatcacttgaaccagagaggcagaggttacagtgagccaagatcacgccactgcactccagcctgggcaacaagaacaaaactccgtctcaaaaaaaaaaaattaaaaattaaaataaaaatcatttctatgacacccattgtcttcctgccaacagcagaaatcgtagacattagaagttagtagcaagctagaagggactgagttacataactctccacacctaggatccagtaggaatgctgacaattccagtgtccatattgctgctggctttcggctcccagggcctttgtccttgcgtgatctcatcttctcctcatgctgttttcaggcgtgtggttgataaacggaggcacacacaagccacagagaaacaattgttctgccagtgaggtcactggtgggtagcgtcgacccagaggccccacggtccccgcttgattggtgaccactcggggccgactttgcacctgtctgactgtggtccctgcttgattgatgaccacttggcccgactttgaattctgtcatttccctgatctggagcactggagtgggttctctctgttcaggtgagggagacacccccctgagatgggccctcctctgttccaggtcaaagccatcttggacgcagcgtcccagaagatagcaaccttcacagacatcggcaacagcctggcgcatgtggagcacctgctgagggacctggccagcttcgaggagaaatcaggcgtaaggcggggtcccggcgggggcggcgggagagtgtgggcagcatcatcaagtgctgctcaggaaggcgcaggaatgggcctcccgcctacggagaacggaccccacagccccccggggatgtccatggggtggggggtgctgctgcctgtacccctcccctcccacaccccacccacagcacatggccctgcccggcctcctctgggtcaggtccctgcagacggtcaatgcctttgctgggaccaccacagcccccagaagcacttgccacagaacagcttcggggattaagcagcatctcaggcatccgcagcagtaaacaaagaaatcaagacacacgtgtgccccgggacacacatcccgtacagcaaggcactgtgtgcctcgaacagaaagaggcctgagctggtcctctgggtggccgtccacaggtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacggtaggccgagccggaccccaccccactcccccccagctgcggaaccagcctcttcctcccacatccaccaccggctgacccttgtcgtggggagggcagctctttggctggaaaatgtccttgcacccttcgtttctggtcttgttggcctagagggtctttttctagaattcatttgccacagttttatttctttttttttttttttctcactgcaacctctggttcctgggctcaagggatcctcccacctcagcccccaagtagctgggactgtaggtgcatgccaccgtacccagctaattcttgtattttgtgtgtgtgtgatagagatggggtctcactatgttgcccaggctggtctcgaactcctgggctcaggtgatcctctcaccttcacctctcagagtgctgggattacaggcgtgagccaccctgcccagccaataatgatttctttaaaagatccagaagcttaaggcctggttgatcctactgcacttaccctgcctctccaggccccgccctgggtaattcactggtgttgtccagcactgtgtccccttgggattggccttgtccagcactgtgtccccttgggattggccttgtccagcactgtgtccccttggggtgctttggacagggtggcgggagcacgaggagtcggtggcccgggatctgtcgggaggacaccccggcagtgtgtgcctggacagggtgacgctctcaccctctcacggcgtcctgccctcggcaatgctctgtgtttccagtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggtaacgctgactcgggctctccatttgcagcttgctgtcccgagcagtgaggcattcctctgtgggaagtttgaaagaatcatttaatgaattatttgtatttatttattattattttttttttgagatggaatctcgctcttgtcgcccaggctggagtgcagtggcacgatcttagctcactgcaatctccgcctcccaggttcaagcaattctcctgcctcagcctcctgagtagctgggattacaggcgcccaccaccaagcctggctaatttttgtatttttattagagacaggttttcaccatgttggccaggctggtctcgaactcctgacctcaggtgatccacccagctcaacctcccaaagtgctggaatgacaggtgtgagccaccgcacctggcccatttaatgaattactaccaaataataggcatatgagagaaacacacagttgggaggtcaagctgaattttcctttcaacacagaaattatttccacgccaaccctgcgaggtggccatcccgcctccgctggcagactttgtggcatgggtgtgttcttcaggaagggcctggccctgggacctggtgatgcccttgagaccaggctcctcctgagccctccacatgcctggggaaggctgcaggcccctccctcgcatggagctgccctttcccgaggccggggccccgtcccgtgtgggggctgcatccccctctccgtccgtagtggccagggctggacacagctgcgctgcgctgacagaccccgcatggagaacatttaaagcgggggttgggcgtgccccggcacgttctgcgcctgactgtgtatttttagtgatgacaccaacatgtgcaaggcaccttactgagcatgcggtttcaggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggtctgtgtggccgcccggtgccccgggtgctgtgggaccctcgggggagccccgggcgttgagagcttggtacatctgaggcagccacctgcgaaaactgtctccacacgcctcctccccttccacctccgggccccagttcagggcctgagggccggttcccgccacccctcacccatgtttataaatggagttttgtcaggacccggccacgcccatcctgtgccacgcacatcttgtaggcatcgttgtggctgcttttccatgaggctggcagggttcagtggtctcagtgaagcccacgtggcccaaaactggaaacacagagctcccacagaggaaccatctccggccttcccagctccagcctctccacggtctgtcctttcccggtgctattgccaaacaacattcctcacacacggcccagaccctgggctccaggagccctgaagagccacgtccgcgcacctcagtccggcgcgcattgctggtcccaaacccgccctctatgccgagccaggcacggcgccatttcccagagactttcccgccacctctgtgtctcaaaacgaaccctcttcccatccttgctggtttctcacacacgaacccaccaggcgagctgctgccccagctttggcgaaagtcagctgtcaatctcaggggccccgggggccaggctcttgccttcctgtgctgggtcccaggcgaccttattttctgcctgttgggagctctcccaggtcggagcccacaggcgctgtgtccccgtgggctgtgggaacgtggggtgactcagggcagtgaggccccaccgtcctcccccttcccgcaccaccacctgtggcctcaaaggccaagtcctgcccacgccaccacctgtggcctcagaggccaagtcctgcccacgccaccacctgtggcctcagaggccaagtcctgcccacgccaccacctgtggccccagaggccaagtcctgcccatgccaccccctgtggcctcagaggccaagtcctgcccacgccaccacctgtggcctcagaggccgagtcctaccctctcctcggggccttttcccgctgggtgcacttcccctctccagagggtcagaggggacttcatgccccgctccccttcttcccaacaggcattcggcgaggctctgagaactccagctccgagggcggtgcgctccggagagggccctaccggagggccaaggtgaggcttgcccaagacaaccccgccatccacacccccctccttggttcacgctgggcctggttctccgtgtggccccccctcccgggcactgcccagctacctggccagctccccatcgtgggaattcagccctgtccccatacgggaactggtgggctctggccttgagagttggcccttgaggttccgtcccgcctttcagacctgacgctgtttttctccccagagtgagatgagtgagagccggcagggccgcggctcagcgggggaggaggaggaaagcctggccatcctgcgcaggtgggtgcgctgcccttctgtcctcacaggggccctccgaccgcagcctgaaccaccagatgccgtcaggcactcgagcagatgcctcacagatagaaggctggtgcagaagtcattgtggttcttacttttgcaccaaccgatacccagagggcctgccgtggctcgagcgtgtgtcctggtccccaccgcgtgaagcacacacacgccgcacacacaccactcgggattcaggagggaagagagggcgatggctgaatgcaacagtgaaggggcatcttcgccccagcaagagcctccacccgccactgccattcacaggagacaccactcaaaggccccaaccagcaccagctgcagcagcagtcaccagctgctcagggctcagtgtggcaggcagtggtgccaggcagctggtgtgtgggagggcatcgtctccagccctccttttcccctgggattcctggaccctcaaactcagggagtgttgtgcaaacaaaagcagttctctttcctccttcacctttaagaaagaaagacctcactggtgcagggccagggaatgcaggtccccagagcaaaactgggaaggagccaaacacccatgaggcacacgcggctccctcccagaggccctcgaggaagaggaggaggccacacaccgaccaggcacccgccactggcttcacactttgcactgtctccgtttttagtatttgcactgaatatgtttgcaagagacgcttggaaccacgtctccccctttcaccatcaaaactccaaaatcaggaaagaagaaaaggctcttcctgatgtgttgacaagcaggtgtccgcaggcagcgccagtgtgaccctgcagggttgggagacggcgcaaaattgggaattacaggaaactgagcttggtgtgaaagctgagtctgtcacttccggcttctgatggaagctggtgaaacaggatgggaaggaagaggggcttgccaagaagcgtccaggcagaggattgtccacacggaggagggtccaagcagaggggcgtctgcacggaggagggtccaggcagaggaatgtctgaatggaggagggtccaggcagaggagagtccatacggaagagggtccaggcagaggggcatccgcacagaggagggtccaggcaggggagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagggtccaggcagaggagtgtctgtacggaggagggtccaggcagaggagtgtccatacggaggagggtctaggcagaggggcgtccgcagggaggagcagcaagtgctcggccctgagacgcagaaggagtggccctcggctggcagttcctgggttgtgagagggagtccagagccctcttgctccccagtcctctcccctgtgccgagtccggggcctctgcgggccgacagctgtcttagaacaagcttgctgaacaacctcaacccaggaccagccccctggctccagtttctgtgcatcacataagcaggcagggccgtaggctgctgaaaggtgctcacacccacagcaagacctgcgcagccagcttgtgcaccctccccttctggatccagtgtggtgggtgcagggtcactccccggaccaccactgcccacctgctgtgtgtgagggcgtgggcagggggcagctccggcgatgccagacccccgccctggccacgaggggccacacagatacccaccacgaggaaggctcagggaggccgggcagcaggcgggcgtcttcttggcagaagagactcgggtggattctagggatgggtcctaggagtaggatgacttgcccatgagcgtgaggaactcagctcattttgcacaggtgggacccaaaagcccaggaggcgagtctgggaatccctcctaccaggcggtgtgtgccgggccaggggcaagacactgccggccagtctgggaaccagggaggcttcagccgccgtctgcagggtctgaggccgcgagctgggaggggaaccccgaggagcgtccagcctgtgggctttgggtcgccgccagtcccctcctgctgggcaggccatcattctaggtggcacctgtgagactgtggagcagaccattcctgctctcccagtgctaaccttttttgctctccacatgacctgccaccaggcacgtgatgagcgagctcctggacacagaacgggcctacgtggaggagctgctgtgcgtcctggaggtgaggctggactcggggagggccgactgccacggggactcccctgggccagctggtggggcttcctctgacaactgctgctcggagcagcctgctgtccaccaaatgcatgtgagagagcgcccacagcagcctggtcgggccccagacggggagcccctgggggcctatcaacaagacacagaccaggcagctcaggggggtccgtacaggggacaagtgtagtgataagaaagaggagctgacacacaacagatgcacaaaccacacacacatcgtcaccaacacaggccacagggtgcctgcgattcccggcacggggcactccagggcaagcaaaactcgtcggaggtgggaggcagattagaggtgaccttggcagtgggctgttgcctgggtgagcttgatgtgagtggtggtcacctgagtatagacaggcatctcattcacccagtgtgcacaggtagtgatcacctgagtgtagacagcgagtgtgcacaggtggtggtcacttgagtgtagacgggtgtccgaatcaccgagtgttcagaggtggtggtcacccaagtgtagacgggtgtctgattcaccgagtgtgcacaggtggtggtcaactgagtgttgacaggtgtctgattcactgagtgtgcacatgtggtcacctgagtgtagacagcgagtgtgcacatgtgatcacctgagtgtagacagcgagtgtgcacaggtggtgaccacctgagtgtagacagcgagtgtgcacaggtggtggtcacccaaatgtagacgggtgtctgagtcaccgagtgtgcacaggtggtggtcacctgagtgtagtcgagtgtctgatttactgagtgtgagcaggtcacccgagtgtagacataagatttgtgccctctgtttcagttacacctgaatcataaaaggttaaaagggagaagggtagaacctccaccccattcccccaaattggtgctgttcataatgcttttgctttgatggatgcctgtcccggtaacttagaaatcacccgagaataaagatgaagggctggcctggcccacagatgagccggcatccctggcccacctgcccccccacagcatcaggcccaggacccccgccgacctctgcgctctccctgcagggctacgccgcggagatggataacccactgatggctcacctcctgtcaacaggccttcacaacaagaaggatgttttgtttggaaacatggaggaaatctatcacttccacaacaggtgggcccttccccccgacacaggcacgcacccgtgatctcttgcagctaatggtgctggcttcagggggctggaatgggggtggaggccaggccatgcctggctagggaggggcgcccaaggggtggactcacagaggcacaggcttgagtgtgggtacatggggccatctctgagcgcccacgtggcaccgtacctggtggcctgtgtctaggcagccaagttgtaagtgagccgccagccgtgaggagagggctctgagcccgagtgcgccctgttttgtggtgcaggaaatgggacccgcctgcccctcatcccctcctcatcctgctgggcaggtggaagccggaaccccctcccaggtgtgtattcggccctttagggggtcaccgaaggccataccacatagcaaggcctgttttgttcccaagctcttgaaaaggacggcaaactaggcgttccttacccatcatgggggctgcttgtcccccgagcgacccgtggcctctccagtgcaggtggcctgtccggcctcttgtcctccactcctctgagctgtttggctgctttaacacagttttggggagctcatgggaaggtgtagggtgcacacgcagtgcagaatgccagggaggctgcagtggacagcccccgctgcgtgtcctggaaggaacccatgtgagtggctcccatgcggccatgtgcttggggaccagcgtgccccactggccatgggaatcgccagtgcttgggatgttgttctgacacctgtttcttgccctctcatcacctcacctgccacttacaaggaggcagcaggtctgcagttgaccaccaaggagccttccacgtccacggagcttgggcagaaccttagtgtcccttagtatctgtcctcatggcccccagggtctcagccagtcctgcacgcaggggtccccacagctttcagctgttgtgctcatgccccaaatccatcccccagacggttttcccctccagccggacttcctccaggggacagatgcaacagaaaacagcccaggagcctgggggcggcgctgcctagggccagggctcagggtgtgtctgcagagaacccacagacccacggccagttatgggggtggcgcctccagggccctgaaaggtcccatctctgtctttgcctgcggccctgtgagccgtgtgtgtgctgagggaaaagcagctccctccaacttctgtgtgcagccaaggccagaaatataaagagactcagcctggggctgcacctgctggcgcctgagagcttggtgctcaggacaggcgtggctgcggcgtctccaagtcatgcggggcagattgcccagagcaaggcgtaacaggcttctgaaaaatgacgtccatccacttgtcactggtccacgtgactcggcctgtctttcatactacttaaaaaccttctttgtctaggatattcctcagggagctggaaaactacactgactgcccagaactggttggaagatgctttctggagagggtaggtggtgttttgacgtgtattttgtcacaacttcttaaaagtactgaataatgacttcagattctactgcaagttcctattctaaccaactgaaatcacaaaatacgatgttttcaatttggctgagataccatgatgctcctgtacccctagaacctcctgaacccccagaacctcctgaaccccagaaaacctcctgaaccccagaaaacgtcctgaacccccagaacctcctgtaccccaggacctcctgtaccccagaacctcctgaaccccagaaccttctgtacccccagaacctcctttgcccccagaacttcctgtcccttagaaacttctgagccctgtgccttaaaaccttctgtgcccctagaaccatctgtgccctagaggcacccaggagcaattgcacttcacaatggggctagggtctgttttttgctaaataacaggtaatttgtaaaactgccagagaaaatgctagaagttctattatataaacaaatcaacaaaccacaccataaatggccttctaagaatggctgcggtggaaccccgtctccactccacgcctgtgctctgggaagtcaggggctctgggacagggagccccattaatggagggcaggccccccagcggagcctgggagccagtgccggccctcggaagctatggggccagcagcaatgcctcgcagggccgggaagacgctgcgtgatgcggtgcccgtccctcaccgcgtaatgcggtgcccgtccctcaccgcgtgatgcgctgcccatccctcactgcgtgatgcggtgcctgtccctcggtgcagatggaagatttccagatctatgagaagtactgtcagaacaagccccgctctgagagcctgtggagacagtgctccgactgcccgtttttccaggtttgtccccggaccttcctttagaacgttactccctttcctagccgactcctgaggaataatgaaaattgtgcaaaccaaaggctctgggttggttccaggaatgccagagaaagctggaccacaagctgagcctggactcctacctgctgaagccagtgcagaggatcaccaagtaccagctgctgctcaaggtgggctccgcggtgaccgtggcccggcctccccagcacctgctggccaggtgtctgtgccgccctggggccccgtccccatcgcgccctgcccctcccaggccaagggcacctcttccgagcctgtgctgaggctgggatgcctttcgaggtcctactgtgcgccactgttaggggtctgaggacgcaggtgagcagacgagtccccgtccccatgggttggcacacagcccagcccacatgggattctgtgtgatgtgctgacccgtccctccagggtggagccgtgcccggattatctggcacacagcagggacgtggggcggcctagactggggattccagctatgagtttgccatgtgggtccctctaaccttcaggcaggaaactgcaactccatgcctttggccagggttagggtggcgagaggaaactccccagggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatccgggtggcaggagggagctccccggggagcaggtgcgaggggtttgcacctggcatccgggtggcaggagggagctccccggggagcaggtgccaagggtctgcacctggcaggggtgctgccccatctgcagcaccactcagtctgtcccagctgcaggagggcaggcagggcagctccccacagaccaggggagggtgagcagcatccctacctcgtgccaagctcctgaggggtctgttccaggggagccagggctctccgtgtcccgacgcggttgcctcaccccatgcccctcaggaaatgctgaaatacagcaggaactgcgagggggctgaggacctgcaggaggcgctgagctccatcctgggcatcctgaaggccgtgaacgactccatgcacctcatcgctatcaccggctatgacgtaaggcgcccagatgcccggtcttccccgccgcctccgtggaatacaccagcccagcaacttggcggcctccctgcacacgcccctcgctttggtgtgaatgtgcaggttctgggcaggaggtctggggtggtccctagataagcccactcccaggccccacagccgggtccacagaccccacagccgggtccacagaccccactgggctctctgggacgtggagaaaatcaggaagcgtcccttgcttggagggcacgcatctccagcaggaacgcagctcagacctcctcactccttgtcttctcctggggaggaggcgtggctcggagcagacgtgacttctgttttctgggctgcgatttgcaggctggtgacttagagcaagtggccccagaaggcagatgtcactttccccgtagagccccacatcaggtcacagcttattcatcttttgtccgtctttatgtccacccagcactcattctcaggtgttttttttttaactaatagagttgatttattgcagcaatttttggtttgtgagataattgagtataaatcagaggccctgaggcttcccctagtgttgacatttagcatgggtgccacacctgccacacatggtgaactagcgctgatgctgattagtgactgagggccgttccccttggagctcactctgggtgctgtgcattctgcggtttggacaggcgtgtaacatcctacacccagcgctagagcatcacacagagcagcttcactgtcctagaagcccatgtgccccgccagtccatccctcctcccccagcccctggcacctgctgacctgtcagtctccacgagcttgcctttcctgggacgccctgcagctggaatcccaccgtgggtgggctttgcagagtggctgctttcactcagcgatgcgcgtccatggccccaggcccatcccgtcctgaacacagccctgctgtcgcacatttaggggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacgtaagtgaggccgggtctgcagcagcacgctcctggccacagaccccgacgggggaagtctgtaactcggtctgaggtggccacgctgacacccagctctcagccttaggtgtaggggtggggtattctgccattcttagccctcacccccaaagtatttccatcatttcgtgcctgcaccaacaccttttaaaaacaaggcagtgggttcactgtgcacgcgaaccccatctccactctctgctcgcagatggctgccgttggcattacggagaacgtgaagggagatgctaagaagttcgagatctggtacaacgcgcgcgaggaggtctacatcgtccaggtgggccacccaccctacccctggcctcttacacattgccacgaatggtttctcatgggaaccagtgcaaggatctgccatgaagttgcatcgagcccaggagcagccgctgtacacttcaggatgctgccctgggctgtcttcaccctgagctggacccagaatgaaatgtggggaaaagtacacatcagacggggtgctgcgaggaaacgggctctccctccccaggggagctcatgtgtccctggacggtgcaagtgtgcatctggcacgcagggccgattctcacggtggggagggtgccgtgccctgggtgccaggcacagttcttcagtcagtcccgtgcatggggcacagagggtcccgcaatgcggggccacccacagtgctttcctcctctcccctcacacgcagccacctgacctttgactcctaagattatctttggatgttccgagagtgaaaccaaagcgtgtttcctcgggggcctgagtactcacctcctggcgtttcttttggggaaacaggcgccaactcctgagattaaagccgcgtgggtgaatgaaattcggaaagtgctgaccagccagctgcaggcttgtagaggtgaggctgtcttcaagcgatcgtttcccgtagcttccgctccaggtgcatttttacctatgttcagagcaaccgcacagtccccccatgcgcaaggtgcctcggcgttgaagtaaagacgctcgttcacgtggtttgtctgctccctcctcgcagaagccagccagcaccgggcgctggagcagtcacagagcctgcccctgccggccccgaccagcaccaggtgagaatggacacgctgccgcaggcctgcgtttctggagcagtcccgagcaggccatttgcacgccagggtcctcggcctctgtcagtgggaccctgtggttattggggttttccttgaggcccctggtgtttatgtgctgacgggtccgtcccagagggtgtacttcacagatgtgtgcctccgacaatgcccagtccctctccagctcttcccggggtgggctgttccacagcacggcagtgcgcacatggcctgtccagatcacagccacgccccagcactcctcagacagtcggggctcagctgggagccggcactgatggcccagcacacacgtgggcacgtttcagactccgaccctgaccgtggcttcgtcgtgtctcttctgcccttgttttttctttattttgttcatccacttatttttttcactttatcctgtttcttatataagctacctttaatcattcatggaacaggatatggcctaaataaataatccgtagaacagtagttttaaaaaagaaacactcccccgcccccccccccgccccccgaaaaaaaaagcctcatacttcagagcaagtagggtgggcgtctgttctcatccagcccgtccgggtttaacttagaagtgtgtggcccctcagaagcaggagggtgggcatctgctctcatccagcccgtctgggtttaacttagaagtgtgtggcccctcagaagcaggagggtgggcgtctgctctcatccagcccgtccgggtttaacttagaagtgtgtggcccctcagaagcaggagggtgggcgtctgctctcatccagtccgtccgggtttaacttagaaacacgtgcaggagatgctgctttaggatcaggccgggagctcagagatatctgaatgcctcaggtcctcagggcgttctgaaagactaaccaggcaacacactatttcctttttgatttgtctgatgtcatcagtccctcaagaggaaactcaaggaacatcaagaagctggaagaaaggaaaacagaccccctaagcctggagggatacgtcagctcagcgccactgacaaagccccccgaaaagggcaaaggtgggtatgtgcagggaccgggcctcacacggaggcctcacacggagctgctcacggagtgctcactgcatccgagaaacctgcgcttcctgcagtgtgaagaagctttgcagagcattcagggccccttgctcccctcttaacagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgccccaaacccaccctcaccgtggtggcgtctgtcatgcatcgtgtgtgaccattcgtgcctccttcgtcacaagggcggccacgcaaaagcgtttctttccacccaatcacgtgttccctgatgctgtgtctcgcgcacagacaccagagttatttagaggtggctttccttcgggaaaatgaaggcgagcttttcaaatggaggcttgctcagaaacggagctgtccttggctttccaggccccctccttcctctccctgccccccacccccgccttctcccgccttctcaggtgagttccctgcagggtgctgaccttgctggctgcgtgtctctgctccgcctggtggcagaggccgctcagccatcttctggggcatccactagtgaacagggctgatgggacccttgagacggagacgtctaatgccctgctcacctgcgagagctccatgatgggaaatacatggcggggaaatgggcccaggaggccctggaagccggccctggcgtgcaggcggctcttctgggaagccctgaaggccagcgtggacaagggctctttccagagaagtaggagtgttttccaatttataaaatgcttttaagttggcctgagacttgaaacaaacaaacaaacaacagattctggtgctgcaaactctgctagcgcagaactaagaaaacgtccctagagacgggccccgaaaggacgcctctgagtgccgcagcccccactcccatgccctcccggcccctccttcactgcgcggcccctcggctccctgtgttttgctcacagaagctcctttttcatcggtggaaaggggccacaacgtcggtgtccccttccagcacgagcgcgggtcagcctcctcgccgcctccctccgtccttcacactctctctccggttgtatttctgcctcctcctcctcttgcagcttctcctaccagtcctgacaaaaaagccaagcggcatgaagtaaagagcgacccgactccctttggtgtgcgaggtagagtggcaccctcgggcacggcacccactctgcgttggcaggaagcgcggcccagctggctgtcaggtggccgtcaaggccacctaagggggatgctctcgtgggtctttatgctgcggaggcagacacgcggttgtgttcaatgtgtgatgctctggtgacaggtcctcgaggacagcacgcctctcagccaactcctcacagcaggtctatctggagcctgcggaactgcccaccccgtcggtggctgctggccacggctgctgcgctggtcacctggccgtgctgggtggagctgggtggggtctcactgcccagtggctgctgtcggctatagggcaccctgttccctgcccttccctgtggcacagtttgccccgacacttcctgctgggaacacagagcatagcaactggcagggccgacccggaccctcctttcccggggccaatgaggccgagctccctgtccgacccggaccctcctttcccgggccgacgaggctgagctccctgtggaacctggcccttctcgtttcctgcctcccttatattctcagggtgaaaactgccctgtgaagcccagagacctcccctggcctgttgaggaccttcaagtgcagggacggggctcatgtttgcaatcttgagttttcaaaaatttgcaaaggttcccaggggtgtaagcagaaccagccttcccattccgcccgcctccacagcctcctcacatgacacagcgagcctcacagaaccaggcagaagctgtggccaccctgggcatgagttcagaggcagggagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctcagcctctgcttccgtctcgtcatccatgaatgaagacagtacagccttgcagggtctcgagaaagccagtgtggtgttgaagccgggccactgcccgtgggtcatttccaccgtggtcagtgtggtgtcagagccgggccactgcccgtgggtcatttccaccgtggccagtgtggtgtcgaagccgggccactgcctgtgggtcatttccaccgtggccagtgtggcgtcgaagccgggccactgcccgtgggtcatttctgctgtggttggtggtagtgagcccaggtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacagcgctcttgatggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccagctcctgtgcacacacagcagcccccctttttttgttcccactgtcctcaatcagacttttggttctgtctggccagaggccccacgtgcggtgcctcagagcgactgggggcctggacggggagggcacgctggcagccaggccccacaggccagtccctgctgctgtagaggaggcacctgggcccccacccttgctgtctctcagcctcccttgctgggggcagctgcaggtgcactcaggaggccaagctgcaggtctgcaaccggaaaatcacagtcctcaattctcacacagatgcaggcctggtgtggtgcctggaaggctcaactgcctccagctgtgaccccaagaaggcaaagcacccgggtggggtggaaggagcagccccgtgctctgctggctgacagtggtgcccaggcccagctcccttctctgcacagacagcagagttccgcttagcacaggcttttccttgccagcgcagacgctgtcagccattggaactggcctgcaagacagcttgctgtggcggctttgcaggcacagggcacacaggcatccgtgcacgcagctcctctgtcctccccatgccccacaccctccatcgcaaggaaacgcttgcttccagtggtaccaaataggatttggaaccagtttgtgcccaagctcaaatctcgttagcatctgcctgtttccctggtgtgcatgtgtcctgcctcgatgcatttggcagcaggtgggatgcgctgggcctgctgcctggttgctggctttgcgtgtttatttagccccaatggcgtctcccatctcccccgcatgggaaaggccggtgctgccctctgggagcctggcaggaggaacactgggttggggaggggggcatgtgtggtcccaagtctggaagaagctccttcctcttctcccgctgggagctgcgtggccgatgggagcccatctccaccgcggcacctgcatggtctcagccttccggttcggtgccgctgtgccgggggctactctcttgccagtggggaccacagccctcggtatcccataggtcaagggcgtcaggccctctcagtgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagggcgtggcttcccagggcctggggatcgaggtctcccacagggtggcccagcaattggaagcagatggtctcaaaccctgaaacgtgccaggcattctggaagtttgcaggggtgtcctgctcagctctttatgaacccgggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacgggggctggtcaagtgcagaggagcagattaactcgtccgacgcagaggaggacggcgggttgggccccaagaagctggtaaccacggcttccctgtgggcacttggggtgggggctgccctccggggattaggggtgcttctggcaggtccacccaggcttgggtcttaggacacagccccagctcctcctaaccctggaaggtccacatgggcctgggtcttacgggcagtgccagctcctcctaactctctctggaaggtccacccagacctgggtcttggggcacagccccagctcctcctaactctctctggaaggtccacctgggcctgggtcttaggatgcagccccagctcctcctagctcctctgtctcagcagcactttgtgtttctgggttaatttccaggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaagctgccatgtgttaatcattccagtgagggttacaccaagaagtgtctgctgcaccttctgtgctgtgcgtggtccatgccccaaggctggaggtgcaaaggggacaggtcccggaggctctggaagggcagagaagccaggcgtggaagggtagggagagccctcggggcctctggcctctcccacagagacagcatgaaggaaggcctgggcgtgagaacagatgtgggggacacagaggcggaggccacgtggcaggaggggaaacaggctggtggaacagggtgcacggggcctggggagggatttggatctcattctttgtggggtgtggggagtgatcctggctactctgggcaccacagaggcaggagccagtacaggccatcacgtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaaaggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaaccattatgaacacctttctgccaatatatttgaaaacagataaataggatttattgttagaattggtcaagaagaaatgaaatacttgggttgatgaataacagttacagaaattgcattgcaattaaaaaaaaaattaccccaaacagataccagatctaggtgattttgtaagcatacaaacatatttataaaagctatttaaaagaatataacaagagaaagcaactcaataaagttatgaatcaaatttaaccttggtacccaaacctgacaaagattatgtaagaaaagaatcagctgggccaggtggctcacatctgttcttctagtactttgggaggccgaggtgggagagttgtctgagaccaggagtttgagaccagcctgggcaacattgcaagacaccatctctacatgaaatttaaaaattagccgggcatggtggcacatacctgtagtcccagctacttgggaagctgagaccttacaagtgagcccaggagtccaaggctgcagtgagctatgatgatcatgccactgcactccagcctgggcaacagagcaagaccctgtctctcaaaatcaaccaaacaaaaagacaatgtaagaaaaaataaaattatgaagatgaatgcaaaaattccaaatgaaatataattaagtaaaacccaattctgtgttataaataaaggtaatactttctaagcaagtaaattcatcccaggaatgcaaggggtagtatgttaatgtggctataatttgccatattaatgaagtgaagggtaaaatcaccagcttaacaaatgcaaaacaataattcaatttttattcaacatgtacttgtcatgttaggccaactaggagtagaagaaaatttctttaactaaataatatgtatcaaacaaaatctttgcagcgaactttttttttttgtttgtttgtttgtttgttttctgagacggagtctcgctctgtcgcccaggctggagtgcagtggcgcgatctcggctcactgcaagctccgcctcccgggttcacaccactctcctgcctcagcctcccgaggagctgggactacaggcgcccgccaccacgcccggctcattttttgtatttttagtagagacggggtttcactgcgttagccgggatggtctcgatctcctgacctcgtgatctcccacctcagcctcccaaagtgctgggattacaggcgtgagccaccgcgcccggctgcagcaaaaattttaagtactgaaatcctttagaaccatccccattggcagcagaactgaacggggccccactactctccagcgccatttagccgcagtactagtgactaccaccgcaaaggaaaaggaaacaaggccagcgcggcggctcaggcctgtcatcccagcactttgggaggccgaggcggcagatcacgaggtcaggagatcgagaccatcctggctaacacggtgaaaccccgtctctattaaaaatacaaaattagccgggcgtggtggtgcatgcctgtaatcccagctactcgggaggctgagacgggagaatcgcctgatcccaggaggcagaggttgccgtgagccgagatgtcgccattgcactccagcctgggcaacaagagtgaaactccatctcaaaaaaagaaaaaaagaaaaaggaaccaaggcatgctaattgaaaaataacttttcatatctagaaaaaccaggtgaattcataaactattgaaactaagaagtccacaagatcaacccacaaaaagttattaacattcctagcaataacaatactattttaacagcaacctaaatactaaaataaatgtaacaaaagttttggacaaaattatgaaacatgatagaaggtcataaaagaaggcctaaatgggagatttttatggatgggacaattcagtatcaccaaagtgttaactctcccccaagttaatctgtgtatttcatcaaaattccaacagaattctttgtggaattaggaagttgattgtaataaacatagaagataaaggtctgagtatagccgtggtgattcggggagcagaggcaggaggaggagggctcacctaccaggcatctggatagatcataaacctgtcatcagtcgtgacaagggggagagaggctaaactggtcgagcagaattcagattcccaggcagggatgtgtgcagggacctggcttgtcctggggctggtcaatctttggcacggaatggcctcttcaggaacgggtgttattgggacagctgcctttccatgtggatgatggcataaaagtatagcccccccaaacttaagattaaaacattattatgaggaaacagaatattcttattgcctagggcaaggatagatttcttacaaaagacaagctacactttaagagatggacaaaaagataagatggacaatctgagcacatcccatggtgaatttctctccacgctaagaccccagacaagggtgaaaagcaggaccaaggcccagagaagaaaaattctgctcaaaatcataactgttcaaccttgcatacattctctctcttaaactgaaagttagcatcctacagcactggtgtgacacccggcaggcccgagggctcagctgcctccagctgtggccccaagaaggcaaagcacccgggtggggtggagggagcagccccgtgctctactggctgacagtggtgcccaggcccagctcccttctctgcacagacagcagagttccgcttagcacaggcttttcctcgccagtgcacacactgtcagccattggaactggcctgcaagacagcttgctgtggcggctttgcaggcacagggcacacaggcatccgtgcacgcagctcctctgtcctcccatgccctgcaccctccgtcacaaggaaacccttgcttctaggattgcaccaaataggatttggaaccaattggtgcccaagctcaaatcctgttagtggctgcctgtttccctggcatacatgcgtcctgccgagatgcatttggcaccaggtgggatgtgctcactggttcccaaaacgagaacacatagcagtttccctggatgtttgttcaatactattcccgggacctgcccgtagattccaattccttatgggtgtggaagagcctggaaatcacgtgtgtgtaggtgtgtggcatgtgtataggggtgtgtttatgtggtgtgactttggggtatgagtgtggcatgtgtacggtgtgtgtgagtgtggtatgtgtatggcgtgagtttgggttgtgcgagcgtggttctcatgtacgagtgtgagcatggagattctttggtagggaaggagtcagggtctccctctgtcgcccaggcttgagtgcagtggcacaatctcagctcattgcaacctctgcctcccgggttctctgtctctgggaccacaggcatgaaccaccaagcccagctaatttttttattttttgtctagctttggtcttgctatgttgcccaggttggtctggaactcctttcctcaagcgatcctcagtcctcagcctcccaaagtgctgggattacaggcatgagccaccacccaagagattctgatgtcacagacatctgactcacacactccctggacagctcacgtgtgcccaccaccacagtcagggatggctgcagatgaacaaggtgctgacgtggtttctgtagcccccaaacaagcaacttgccttgagatgacaaccaaagttttcctgtgtcctccacactcaagagtgactgtgaggcggaggggcccagcccttcttgcaggcgggaatgagtggatgggtggatcaacagaggctgccacaggagagagggaggcctggcctgggaacagagctgtgaccgtgcccttccccagggtaggggctgaaggaccctcccatcctagtgacagggccacagcatgtccaaggaggccccagaggaggtcccgggagtcctgggagagcctggttagcctccctgaagggaggaagtggggttttgtgagagggatggtgcagcagcccccacacctgctactccgtgtggccgggtccagccccaggcaaggttccaggcatgcccctgggacagacgtgggagggagaccagcaggcaggtccccctcagggaggtatggagcgggtccccggggccaggtggagcccctcacacctgtgtcctcaaggacccacaccaggacaatggccataggcgggcacctgcagccgccctggccagcagtgagacgggcagagagcccagccagatagcccggttcctgccccctcccgcctgcccgcacagagagggctgcatgcaggtgagggtccatcacctgaagagcttcaccagccccgaggccatgagccactgaatctctcagggggttttggcgcttgaggttccccaggtcattctgctgcccagagagggttgaggacctctgacctggagccccaaaggggaagggtaccctaagaccagccagccatctactctcaggtgggaaaggggtagggtttagatatggccccctcccctccacgtcctgaaattaccttgggctgtgctggccgagagccgcggggaccagatttgagctggacgtgagctttattccagacggagcagctactttgtaagcgatctccctgggatcgatatcatggaggggcacagatgggcttcagctgtgctgggtggaagagaaaacatgccctgtcggcccctcagcaagtgctctgctctctggactgagatgcaggtcagcagcaagcagggaggctttgggggtgctgggggctgctttgaaaggcacccctgagctaagacttggctgttgggaaggaatcacctccctccctccagccgtaaaaagaactggacatcagcttccaaagaagtcatcagcaatgcaactgttcacatggaggatactccctgcttgaggggtcagacaggcctgctgggcaacccaggaggcttggatgaccgtctaccccagtgtttttgggatggaaagttccacattctgagaaccctcagtccctgggcaacctggggtggttagtcaccacagcttgtggcttgggcccatgacagcaggtagaaatgacgtggactgccgccagccgggcacagtggctcacgcctgtaatcccagcactttgggaggctgaggcatgtggatcacttgaggtcaggagttcgaaaccagcctggtcaacacggtgaaaccccatctctgctaaaaaaaaaaaatatatatatataaattagccaggcatggtgacgtgcacctgtggtcccagctactcaggaggctgaggcacaagaatcacttgaacccgggaggtggaggttgcagtgagattgcaccagtgcactctccagcctggcaacagagcaagactctgtctcaaacaaacaaaacaaaacaaacaaaaagacgtaagatgtggaccgctggagaatgggggtgctgcctgcagtcaaaacggagtgggggtgcccagctcagggccagaatgatcctattcccggcacttctcagtgaggctctgtggctcacctaagaaaccagcctcccttgcaggcaacggcctagctggcctggtctggaggctctcttcaaatatttacatccacacccaagatacagtcttgagatttgactcgcatgattgctatgggacaagttttcatctgcagtttaaatctgtttcccaacttacattaggggtttggaattctagatcgtatttgaagtgttggtgccacacacaccttaacacctgcacgctggcaacaaaaccgtccgctctgcagcacagctggggtcacctgacctttctcctgtcccccccacttgagctcagtggctgggcagcaggggatgcatggccactggccggccaggtgcagctctcagctggggtgttcagaggacgcctgtgtcctcccctcccccatccctctgtcacccttggaggcagagaactttgcccgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtggcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaagggcgtgtggggtgcagaggatggggcatgggggggtggggatggcgagtggggctggggcctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtccgagtgaccatgcctcagtttcctcatgtgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccactctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagtcgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtgactcccacagccattgagcagagacactcaggaccttgtgatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagccccccccgtgacatgagaccacctgataccacccagagagtggctgtgagcggaagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgaggactgagagttaaatgtaaacatctggaaactacaaaatgagcacgaaatgatgtttttattcttagaacagaaagtccccacacccgcggccctggtgactgatgaggatgaggttctgcggggcctctctggccgcccagctctgcctggggaaggtggggccagagtggatgtgttcccagcgtggtcactcccctgcctcgccagcaggtctcggctccaatcaggaggcctaagccaagtgataagcagccagacaacagccatcccagctggggcgtggactttgctccagcagcctgtcccagtgaggacagggacacagtactcggccacaccatggggcgcccactgcacctcgtcctgctcagtgcctccctggctggcctcctgctgctcggggaaagtcgtaagtgcccctcgcccttcagacccaaaagcagcgccagggagcagggaggggcggcagttggggaaaccctctcatctctgcagcctggacggtgggtgccttgagtgctgccagaggctgggctcggatggctgggcttggcctttccagccaacggcatcctcaaggccagctgtggctccctggggctgagagtcagacgggcggatcagaggtcacagagacaaaaacacaaggacagagtcagagagagaaagggagagggaaggagaaacggagacacagtgagatgggaggccaagaggcagagacagaggtagaaagacggagacagagagagagggaggggttggggcaggcagagacaggacagttagccatctgccaccacagggaggcacaggacgaggggcacagcagaggagctcccagggaggaggaggctgagccgagccagtgccaccactctcggactggctccgtcggggaaggagctgcctaatgcacagctggacaggtgggggcagcagggctgtccaggacccccgggtctgtccaaaagcagaggcccagacaggacagaagccaggcaagcctggggacagcggaggaagaggaggcccctctggtggggacacgagagacagggaccctagacttgtttgcatcctggacaaagtggacaggcaggggcaccaaggggacccaggcctgggaagggaatgtgtgagggagagacggagcagggggagaccctcgtggggtggaaaggggagacccctgggaaggctgagtggatcctcagtgcatcactgacctaaacggcccctccgcctggtgacttggagctccagtcacatcacacgggggtcttctccatcccaccctcaaccccctgccctccccagcctctgtcccctgagccacatcttcctgtctcccacgcggaacgggactcccgtcttcatggggtactgtgtggctccaactcgcccagccttcttcctccccctcaggccacactgccccctgcaggagcccactgtgatgcttgtggtgggatgagatcagcgtgggtggaacaaggccctggaaggacccatgccatcatcatcgacagcaaagctactctgcaaacagacagatgcttccgcgaattggtagaaaattctgcagccggaatgctctaggatcctgaggccctaagcccggcccggggctcccgaggccctaagcccggcccgggactctggaagctgctctggcttattgggaatggaagttggcaggactcctcttcctgggaagaagcagagggtggggatgagaagacaggccaggagcccacccagacccacaggaggaaactaggggagttatgcagagtcctggtggagcgccagcttcccttcctgccaatgggaaatgcaggcgcccacctcgcggacctctgggtccacagggtattggcacccttagctgtgtgatgcgggcctggctcataaccatggcctgtggtgtccccgggggccggcctggaccctgggtggacatggccagccccggagagccagggccaggccatctctctcccctactctgcctcagaggcctcggcagctgcactgtggggtgggtggggctgaacacaggtcccagaaggtcccactcaggaccctgctgtgcacacttttgattttaataaaatcagaatgcgcacagcatctgcagtctagcctttaaacgagcacagctgtcctggcagtcacggaagttcttctggggcggtgggacctcagcattcctttgctggtactgctacaagaaaggacaatggaccaagtagcttaaagcaacagaaacatttctcccacagctctggaggctggaagttcaaaatcaaggcgtcagcggggctggttcctccagaggctgggagagagtctgctctaggcctgtttcctggcctcggggtgccagcggcctcacagcccatggcttgtgggagcattgctcccatcgctgcctccatcatcgcatggggttctcaccatggctgtttttctgtcttcttttctctcagaaggacaccagtcattggatttagggctcactctactcccataaaatgtcttcctaactaaatacatcacaaaagttctatttccaattaaggtcaggttctgaggttctgggaaagacatgaatttggagggacattattcagccctgtcctgccacctgtgagtgttttctgcaatccaactttttattttaataaaatcagaatacgcagagcacctgcagtgccagcctttaaactactgctgttgtactggcaatcattaaagctacgtggcttcagtttcaatctttacattcaacaagtttaaacccattcttcatgagtttggaccttactgactgaaaattttgcttgctggtaaaacttgctcaaatgcagttgctgactgtggaattcactgatgttgccaaaacaacaaacacaactgtgtgctcgaggattgcaatgctcccaacagcttctgaagaaacaaaccacacgacaaatgtctaccaatctggatgctccatatcagagttctagagtgttccattaatttcttgagacaagtgcctaaaaaccttgttttaatttcgttttgccaaaatcccattttactcacatcagaaagtgtggccacgtggcccagacccggcctgctcagtctgactgaagcgttgatgcgactcagccataacagatagcagaagcgcccagattcagtccagagggctgagccaggcacgccatctttccttcattccctcaacacatattggttaagttccggccgtgctaggcacgggcatacagctgtgaccaaacacgtcaagtctttttccagcggagggaaggataagcctgtcagcatgtaatgtcagagaggggttgggtgctagaagacaaatagcacagtgtaaggggatgaaagagacacgagtgggggcaacgtcagagggcgtggtcagggagggtgtctcggagggcgctgggcctgagccacttgggtatctgtggaaagaatgttccagacagggaggtgactggtgcaaaagtcctggggtgtgagtgttgggctcagccagggtcagcgcagagcccagtgtggcagagagaggtgaatgagggcagagttgaaggtggtgaggcctgggaggcctggccatgggaagaccctgggctctgttctaagaccactagaggcagattctgggtagtccttgacttccttgcatcaccctttccaccccgtgcctgccacctgtaccctcttcctcacacagtccagctcaaccttataggccgtgtcctacccccatgagctggggagagctgagcaggcttcagggagatgggaaaaggcgggaactggacaggggctgcaaaggaaaggtgacttcttactggtcaatcagcctggggatgctcgggggtggatgccaaggggaacagagctgtggccgctatcacagaacagcgagttcctctaagaggtcagaggaggcgcaagggatcgaccagagacagtgagggcgtcaggctccagttgagtggggaccaatccttgtggcaagtctgtgaaccatcactgtggctctagggtagcagagaaaaaagcaggcatatgtccatctggccacaaggaaggagaccaaggggaagagagaaggtaccaagagaggtgttcacatggaggtgcgtcagaacaccgagggcaaggcagaacgcggtcttcagaccccaactggagcccaggaggcccgcgagtcccagtttgggaaacactaagccaggcttggataacttgtctgaggctgtggtcatcccaacatgagagccagaggccccaagggagatgggcattccccacccctcagcttcctcagtgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcag

SEQ ID NO: 800 - DNA, 5095 bp, Homo sapiens
tatttgaatctttctctccctatcagggcaaatgggacacagatcaactcaggaagacaaaggcagcccctgcaggcagtggtggggtgcaaatgctgccggcccagcgcctctccccacccacacggcgccaggacgaaaccctgatgtggccggggctccggcgagggctttccgggccgacggtgtgaactgcacaggtcagcgtgggtttgctggcactcccaggcaggcggcttaaacagcgggagctcattccctccggtgctgggggcaaggtgtctcgcagcgctggttacccgaggcctctctccttggcgcgaagatgacgtattccgtgtcctcacgtggtggtcctgtgtgctgcgtcctcgtctccccttctcatgaggacgctggtcacactgggtcagggcctcgctttaccttgacaatctctacagctccacgcccaagtgcagccacaccctgaggtcctgagggtcacagggtcacagctccagcatgaggatttgccgggacagagttcagcctgtactgagccgaacagaaaatccccggcacgctgtctcctccagcctccagaccacggtgggtggggaggcaacattttacctcttggggttttttggtcgggcctgataattaaaatcagcagatgagctggagaaaggcacacgcactccagcacggtctgtgtggccgggaatggcctttccttcctgaaagaggaggtaacaccccacggggaagacgctctccagagccagaagaaagcagcgttcttatccttgtggatggctgtttcagctcaaaacaacccttacaacagtgtggcttatttgggcagccccttctgccccttgacaggcacctcgcgagccggcgcacccccccgcccccaggacccgcttcccgcacccggggctcctcagccagggggaagcaggtgtgacccccaggctgcaggctcccctccttctgatctcttcttttgaagagcccacagcctctcagcacccaggaggcctcagctctctgggcaagtggtgggtgcagggtgggggccttggcctcacacacgctctggcactgcctggcctcctgggacggttcctcagaggcacctgctttggacactctgatgtcgggagccccgcggatgctgccaggatgggagaggaggccgctgtctctctccaacaagtgctgggtcgtctggagcaacaagggcaaatgggcgtcactggggtctccacaaagccacctgcagtctcttggtgggtgtattagacagtttccatgctgctgataaagacatacctgagactgggtaatttataaagaagaggttgaatggattcagttccacatggctggggaggccctgcgatcatggtggaaggtgaaaggcacgtcttacatggcagcagcaggagagaatgagaccaagcaaaaggagaaaccctcataaaactttcacatcggatctcgtgggacttataccacgagaacagtatgggggaaccgccccatgattcaatcacctcccaccaagtcccacccaccacacagattcaatcacctcccaccgggtcccgcccaccacacagattcaatcacctcccactgggtcccgcccaccacacagattcaatcacctcccaccgggtcccgcccaccacacagattcaatcacctcccaccgggtcccgcccaccacacagattcaatcacctcccaccgggtcccgcccacaacacagattcaatcacctcccaccacacagattcaatcacctcccaccacacagattcaatcacctcccaccacacagattcaatcacctcccaccgggtcccgcccaccacacagattcaatcacctcccaccgggtcccgcccacaacacagattcaatcacctcccaccacatagattcaatcacctcccaccacacagattcaatcacctcccactgggtcccacccaccacacatgggaattatgggagctgcaactgaagatgaggtttgggtggggacacagccaaaccatatcagtggagacgcgcaggggcttccggcccccatacactcccacctcccactgccctgtaggactctcctggctgttccagaaggggcttccattctccacgttccctggggcctcgtcctccttgcccttctacttcctcttggaggggctgaccttggccctcctgggctgaccccagcacagctgtgcccagagtgtgaacggagccccctggctcccgacactgcctgaggccctgccgggaagtgtggctccaggaggacgggctggcctcccggggaggatgcccccacctgcaagggtttgtccaccacccatagccactcctggactggggcagaccccacacctcagcatggactaaggaggccggccaggctgaaccaagcctcacccttccctgggagaaaggcctgggttggtgtccccaaagccacacctcctcatttttctcataccagagctgactcacaatagaattaccaaaaaagaggaattcaaatggagcaaggaaaggaataaagaaatgaggcaacgtatcatggagtcttcacccagagccccccttaaccctctcctgcctggagggacagcagccacctgcctagaggcgcagtccgttctcttctcccagggcctccaagtggcctccccctctgcattcctggagatggcagcacgtggtggtctgtctgcccagcactccttgagtggacacacctttcctgaggttatcacagggccggactctcacctgaggcaccacaggtgaatgccactgtcagagcagcgctgcccatcaccaaagatgtcaactgtcaccagtgatgtcacctgtcatcagggcggtgccacctgtcagagcagcgctgcccgtcatgaggcgtcaactgtcaccagcgatgtcacctgtcacctgtcagagcagcgctgcctgtcaccagagatgtcacttggcatcagcaatgtgacctgtcatcagggcagtgccacctgtcagagcagcatcacccatcaccagggacgtcacttggcatcagcaatgtcatcctgctccccaggtgccaccctcctccctgtaccccccacccctaatgcccacatgtgcaattcccagtgggtaccactggaaaaccaaggcagtcctcagaaagaataaaacatctgttttaattggccagtaaaatacattgcaaatcattagtattttataaacagaaacattaagttataaatccatgttaaaaattgcagctcagtgcagccccaacagctgtgtgtccaaaagtctatttttacaacattttcctccagtatttttgtgacaagaaagttcctatctgccatctagatcaagagcctgaactacagtattttcaaacaagaaccgggagaagtcggtacaaggatacgtcgtgctgtgtatttaaacggcgcttcccacacacctgccgtctgcatcccgggaggacgccctttgggaaaggcctcctcggcagtgtgaggtctggaggggtctgcctggaccccatttttaggatgctcccctccccaataaaacagcagcccccgcccctgccctgcacagcatctgggggttcataacacaggtgcaatactgaccatgggccctggagggacgtctgcaccccgaagcccctgtacctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctatttttaaaatcttcaaacttccacggggggtggcaaatgttaattctgattttaaaccccattcaacagcaaaacgatgtgggcttcaactgtgggctccgcagacgcctggagaagctggagcccacacctttccctccaagggactctgtggacagaacccgtatcccccaagcaccaaggacatcctcagactgggacttctgtgtaattctgcacctcccagccataaaactgacccctcagccaggaatcaaacgaacctcgaaagtggaacagggaggccgcctcccatggctgcctggatggcaggcacagtgggagagtaatgctctgaacctcccaatgtgatgaagccgaaagccgaggcggggccagcaggcctcccgggcacagagccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgca

SEQ ID NO: 801 - DNA, 3055 bp, Homo sapiens
tcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctccc
